United States Patent 11,446,398 (REGULATED BIOCIRCUIT SYSTEMS) - sequence listing, part 63

SEQ ID NO: 159555 - DNA, 1005 bp, Homo sapiens
  Payload ID: 11226
  Gene Symbol: NOSIP
  Gene Name: nitric oxide synthase interacting protein
  Uniprot ID: Q9Y314
  ENST ID: ENST00000596358
  CDS Start-End: 60-965
tttccggtgtcggggcacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaa

SEQ ID NO: 159556 - DNA, 697 bp, Homo sapiens
  Payload ID: 11226
  Gene Symbol: NOSIP
  Gene Name: nitric oxide synthase interacting protein
  ENST ID: ENST00000601015
  CDS Start-End: 1-697
aggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaa

SEQ ID NO: 159557 - DNA, 1167 bp, Homo sapiens
  Payload ID: 11226
  Gene Symbol: NOSIP
  Gene Name: nitric oxide synthase interacting protein
  ENST ID: ENST00000600019
  CDS Start-End: 44-235
acagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcacatggctacctgtatgagcgtgaggccatcctggagtacattctgcaccagaagaaggagattgcccggcagatgaaggtggctccccctgtgcccatgtcctccacacagcctggtggtcatgtcggaggccctcatgagcatccatcactgtcactgttacctcctcactcagctgggtggcccagggtggtctggaactgcagcaccgcccaggcaactgctgtgcgccaggcagggctgagctcaggtcatggcttcacttctcccgtcctcactcactgtccgtccatagacatgggctcctcagcattcccttagatctgaagtctacatcccccgtcccaaacacgggctggggcatgcactgtatagaaaacttaattggccagcaggtgacattaattaaatgcttagctgagtgccaggtgaggctctccatgctgtaaacactcaccttatgtaacccttcagtgagccgctgaggtgggtaaccactgttaggctgttttacagatgaagaaactgaggccaggagaggtcatagtgctcacttaggccacagagtgacagagatgggctttgagccctggcagtctggctatacaacgcagtaaggttcacacccacccagggtggcagttaccaccctctgccacatagtgcctccatcagagggtcccctttgtgggcctcagtttacctacctgtgaaatgggaggaagatacccccagccccacgggcagatgctcagcccactttccccgacgcaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctg

SEQ ID NO: 159558 - DNA, 529 bp, Homo sapiens
  Payload ID: 11226
  Gene Symbol: NOSIP
  Gene Name: nitric oxide synthase interacting protein
  ENST ID: ENST00000598296
  CDS Start-End: 1-529
atgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaaacagctccgtggaccgcgtggggctcatcacccgcagcgagcgctacgtgtgtgccgtgacccgcgacagcctga

SEQ ID NO: 159559 - DNA, 602 bp, Homo sapiens
  Payload ID: 11226
  Gene Symbol: NOSIP
  Gene Name: nitric oxide synthase interacting protein
  ENST ID: ENST00000594932
  CDS Start-End: 20-211
ctgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcacatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgctccgtggaccgcgtggggctcatcacccgcagcgagcgctacgtgtgtgc

SEQ ID NO: 159560 - DNA, 833 bp, Homo sapiens
  Payload ID: 11226
  Gene Symbol: NOSIP
  Gene Name: nitric oxide synthase interacting protein
  ENST ID: ENST00000599537
  CDS Start-End: 109-833
ctgggcacaggccccaccctcctatacggctccacacatacaacgctgggccacgcccctagaccattgcatggggccccgcccccgcactccaagccccgccccaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctc

SEQ ID NO: 159561 - DNA, 2294 bp, Homo sapiens
  Payload ID: 11227
  Gene Symbol: NOSTRIN
  Gene Name: nitric oxide synthase trafficking
  Uniprot ID: Q8IVI9
  ENST ID: ENST00000317647
  CDS Start-End: 230-1750
attctcactatctcacactggccgtcttgacccagagcagttctttactttctcgggacacaaacgggatgaaagtccagggctgggacttcctccttggaatgtttgacaaggactgacgtactctaggccctttgaatcccggaagtccaggacacacccaaccttgattacagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtctttttcctctggatttgggtggcaacagaacacagcaggcctatgagggggtcaagcagagcctgggagatgaggaacacagatcaattccaagaagagagacaggcaatcaagacaccaatgagatcaacccaaattaggggatggtaggatatctctgacaaacccacagccaatatc

SEQ ID NO: 159562 - DNA, 1446 bp, Homo sapiens
  Payload ID: 11227
  Gene Symbol: NOSTRIN
  Gene Name: nitric oxide synthase trafficking
  Uniprot ID: Q8IVI9
  ENST ID: ENST00000397206
  CDS Start-End: 160-1446
cacatttcaacatgagggacccactgacagattgtccgggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataa

SEQ ID NO: 159563 - DNA, 1437 bp, Homo sapiens
  Payload ID: 11227
  Gene Symbol: NOSTRIN
  Gene Name: nitric oxide synthase trafficking
  Uniprot ID: Q8IVI9
  ENST ID: ENST00000397209
  CDS Start-End: 1-1437
atgagggacccactgacagattgtccgtataataaagtatacaagaacctaaaggagttttctcaaaatggagagaatttctgcaaacaggtcacatctgttcttcagcaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataa

SEQ ID NO: 159564 - DNA, 475 bp, Homo sapiens
  Payload ID: 11227
  Gene Symbol: NOSTRIN
  Gene Name: nitric oxide synthase trafficking
  ENST ID: ENST00000427068
  CDS Start-End: 1-62
tgcagagagacattgaaaaagcctcaaaagacaaggaagaagttaggcatgtcagactgtgaagcagctctaaagcaacaaggatgacaaaaacgactccacatttgtgactctgatgtctacctagtaacttgttttatatggaccacgataactcattgcaatggaatactagagagcaaattcaagatagaaaacatttagtgatgtgaataccataacgaggaagaagccaacgttgggtaactgttagcaattgctagaatgggtcgactgaaagaatttcaaaatctcatctggaaaaataacaatcaagatgctttaagcaccagcacttctcaaatttcattaagtgaagagaaaggcctggaacgaatgcttaaaacgtactccagcacctcctccttctctgatgcaaagagccagaaagacacagcagcgttaatggatgagaacaatttgaaactagaccttt

SEQ ID NO: 159565 - DNA, 794 bp, Homo sapiens
  Payload ID: 11227
  Gene Symbol: NOSTRIN
  Gene Name: nitric oxide synthase trafficking
  ENST ID: ENST00000447264
  CDS Start-End: 300-794
aatagatcagcttcatttttgaaaagttctcctgggtctttcatatccaggtagaagagacttcatctttattttaagaactcatccaaaagtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccaca

SEQ ID NO: 159566 - DNA, 2537 bp, Homo sapiens
  Payload ID: 11227
  Gene Symbol: NOSTRIN
  Gene Name: nitric oxide synthase trafficking
  Uniprot ID: Q8IVI9
  ENST ID: ENST00000444448
  CDS Start-End: 477-2168
acagatgcagaacccagggatatggagagccaattgtatttgtaaaacacttagaatggtgcctgacacgtgagttgctttgtctaattctagccctgtggtagctacccaagattgttgtaacctccagtgatcaagttctttggataagcaaagagggagggcattaagtgtgtggaaaagacccctcctctccactcttgttgcaaggactcaggatcctgccctctgagggtttacagaagtcattctcactatctcacactggccgtcttgacccagagcagttctttactttctcgggacacaaacgggatgaaagtccagggctgggacttcctccttggaatgtttgacaaggactgacgtactctaggccctttgaatcccggaagtccaggacacacccaaccttgattacagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccaggtaacccacagcatctgcctatatgccttttgggtcaaaagagcctggggaaagtgtgtgagtgatttaagataccaagacacattccttcctggaaatctccctccactatggtttggatatgacatagtcaagaggctaatcatgagactttgttcagtctgtcttcagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtcttttt

SEQ ID NO: 159567 - DNA, 2535 bp, Homo sapiens
  Payload ID: 11227
  Gene Symbol: NOSTRIN
  Gene Name: nitric oxide synthase trafficking
  Uniprot ID: Q8IVI9
  ENST ID: ENST00000458381
  CDS Start-End: 759-2450
gcgcatgcagcccttcccaagcactggtagggcactgggcatgcagacagcccaccagaagggaagaatcaggagaaaagggatgcaagatcccagagataaactgaagcacaagagggtaaaaactttgtccttggtcttacagccagaaagtggtgatgcaaagaacttagtccaagctttgatctgttctgcactgcctgccaaagcagaaccttgagaaatacccatgtttgggggatgagaagaagaagataaatcagcaaagaaaatagtgataagaaagatgcagaacccagggatatggagagccaattgtatttgtaaaacacttagaatggtgcctgacacgtgagttgctttgtctaattctagccctgtggtagctacccaagattgttgtaacctccagtgatcaagttctttggataagcaaagagggagggcattaagtgtgtggaaaagacccctcctctccactcttgttgcaaggactcaggatcctgccctctgagggtttacagaagtcattctcactatctcacactggccgtcttgacccagagcagttctttactttctcgggacacaaacgggatgaaagtccagggctgggacttcctccttggaatgtttgacaaggactgacgtactctaggccctttgaatcccggaagtccaggacacacccaaccttgattacagtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccaggtaacccacagcatctgcctatatgccttttgggtcaaaagagcctggggaaagtgtgtgagtgatttaagataccaagacacattccttcctggaaatctccctccactatggtttggatatgacatagtcaagaggctaatcatgagactttgttcagtctgtcttcagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttaccttta

SEQ ID NO: 159568 - DNA, 1569 bp, Homo sapiens
  Payload ID: 11227
  Gene Symbol: NOSTRIN
  Gene Name: nitric oxide synthase trafficking
  Uniprot ID: Q8IVI9
  ENST ID: ENST00000445023
  CDS Start-End: 199-1485
ccagaatgctggagcgtaggtgaaaggacaaaagccagacacatttcaacatgagggacccactgacagattgtccgggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaaggaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttaccttt

SEQ ID NO: 159569 - DNA, 584 bp, Homo sapiens
  Payload ID: 11227
  Gene Symbol: NOSTRIN
  Gene Name: nitric oxide synthase trafficking
  ENST ID: ENST00000439509
  CDS Start-End: 56-349
agtgtccagaatgctggagcgtaggtgaaaggacaaaagccagacacatttcaacatgagggacccactgacagattgtccgtataataaagtatacaagaacctaaaggagttttctcaaaatggagagaatttctgcaaacaggtcacatctgttcttcagcaaagagatggggttctcattctgctgctcaggctggagtgcagtggtgcaattatagcttgctgcagcctcagactcctgtgctcgcgaactcctctcgcctcagcctctcaagtagctaggactgcagggcaaacctggaaattagctatgccaaaggacttcagaaactggcaagcaagctgagcaaagcattacagaacacgagaaaaagttgtgttagcagtgcctgggcctgggcctcagagggaatgaaatccacagcggacctgcatcaaaaacttggcaaagcaattgaattggaagcaataaaaccgacttatcaagtcctaaatgtacaagagaagaagagaaaatcacttgacaatgaagttgaaaagacagcaaatcttgtcattagcaactggaatcagcaaattaa

SEQ ID NO: 159570 - DNA, 475 bp, Homo sapiens; identical to SEQ ID NO: 159564
  Payload ID: 11227
  Gene Symbol: NOSTRIN
  Gene Name: nitric oxide synthase trafficking
  ENST ID: ENST00000613802
  CDS Start-End: 1-62

SEQ ID NO: 159571 - DNA, 1263 bp, Homo sapiens
  Payload ID: 11227
  Gene Symbol: NOSTRIN
  Gene Name: nitric oxide synthase trafficking
  ENST ID: ENST00000610378
  CDS Start-End: 1-1179
cttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaagaaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttaccttt

SEQ ID NO: 159572 - DNA, 1723 bp, Homo sapiens
  Payload ID: 11227
  Gene Symbol: NOSTRIN
  Gene Name: nitric oxide synthase trafficking
  ENST ID: ENST00000618893
  CDS Start-End: 1-1179
cttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaagaaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttacctttacatgtttttcttttgaaatggatggagttctacctgcatgtcacagcactttgcattcatgattattagcttgaaacagtcagaaaaaagatggatgggtggagacagacaaggaagaggctccttggttcctagaggagtttccaaattctaggagaccctagagatgatccagtataacccctggtgtcacagaaacagacggagtccaaggtgggttcagctgcttgcctgaagtcagagttatctggtagacaacagcagtgggacttagatgtctttttcctctggatttgggtggcaacagaacacagcaggcctatgagggggtcaagcagagcctgggagatgaggaacacagatcaattccaagaagagagacaggcaatcaagacaccaatgagatcaacccaaattaggggatggtaggatatctctgacaaacccacagccaatatc

SEQ ID NO: 159573 - DNA, 1179 bp, Homo sapiens
  Payload ID: 11227
  Gene Symbol: NOSTRIN
  Gene Name: nitric oxide synthase trafficking
  ENST ID: ENST00000620516
  CDS Start-End: 1-1179
cttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaagaaggatggtggtttggatctttgaatgggaaaaaaggccattttcctgccgcttatgtggaggagttaccttcaaatgctggcaacacagctacaaaggcataa

SEQ ID NO: 159574 - DNA, 387 bp, Homo sapiens
  Payload ID: 11227
  Gene Symbol: NOSTRIN
  Gene Name: nitric oxide synthase trafficking
  ENST ID: ENST00000619846
  CDS Start-End: 1-387
cttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccagagcattctggagctggagaaggaaagaattcaacttttatgcaataacttaaaccagtacagccaacatatttctctttttggccaaaccctgaccaca

SEQ ID NO: 159575 - DNA, 1179 bp, Homo sapiens; identical to SEQ ID NO: 159573
  Payload ID: 11227
  Gene Symbol: NOSTRIN
  Gene Name: nitric oxide synthase trafficking
  ENST ID: ENST00000614842
  CDS Start-End: 1-1179

SEQ ID NO: 159576 - DNA, 1179 bp, Homo sapiens; identical to SEQ ID NO: 159573
  Payload ID: 11227
  Gene Symbol: NOSTRIN
  Gene Name: nitric oxide synthase trafficking
  ENST ID: ENST00000611498
  CDS Start-End: 1-1179

SEQ ID NO: 159577 - DNA, 1435 bp, Homo sapiens
  Payload ID: 11227
  Gene Symbol: NOSTRIN
  Gene Name: nitric oxide synthase trafficking
  ENST ID: ENST00000610364
  CDS Start-End: 1-1350
cttgacaatgaagttgaaaagacagcaaatcttgtcattagcaactggaatcagcaaattaaggccaagaagaaattaatggttagtaccaagaaacatgaagcacttttccagcttgtagaaagctccaagcaatctatgactgagaaggagaagcggaagctcctcaataaactgacaaaatcaactgaaaagttggaaaaggaagatgaaaattactaccaaaaaaacatggcgggttattctaccagactgaaatgggaaaacacactagagaactgctaccaggtaacccacagcatctgcctatatgccttttgggtcaaaagagcctggggaaagtgtgtgagtgatttaagataccaagacatattccttcctggaaatctccctccactatggtttggatatgacatagtcaagaggctaatcatgagactttgttcagtctgtcttcagagcattctggagctggagaaggaaagaattcaacttttatgcaataacttaaaccagtacagccaacatatttctctttttggccaaaccctgaccacatgccacacgcagattcactgtgccatcagcaagattgacattgaaaaagatatccaggctgtaatggaagaaactgcaattttatctacagaaaacaaatctgagttcctgttaacggattactttgaagaagatcctaacagtgcaatggataaagagagacgaaagtctttactaaaaccaaaattattgagactgcagagagacattgaaaaagcctcaaaagacaaggaaggcctggaacgaatgcttaaaacgtactccagcacctcctccttctctgatgcaaagagccagaaagacacagcagcgttaatggatgagaacaatttgaaactagaccttttggaagcgaactcctacaaactgtcatcaatgttagcagaacttgagcaaagacctcaacccagccatccttgtagtaattccatcttcaggtggagggaaaaggagcatactcatagctatgtgaaaatatctcggccttttttaatgaagagattagagaatattgtgagcaaggcatcttctggtgggcagagcaatccaggttcttcaactccagcccctggtgcagcccagctcagcagcagactttgcaaggccttgtattcttttcaagccaggcaagatgatgagttgaatttggaaaagggtgacattgtgattatacacgagaaaaaagaagaaggatggtggtttggatctttgaatgggaaaaaaggccattttcctgccgcttatgtggaggagttaccttcaaatgctggcaacacagctacaaaggcataaaacaagactctgaacatactaccttcacactcggtaatcaacaatacagtgtggttcaaataagaataaagtgctcttaccttta

SEQ ID NO: 159578 - DNA, 1437 bp, Homo sapiens; identical to SEQ ID NO: 159563
  Payload ID: 11227
  Gene Symbol: NOSTRIN
  Gene Name: nitric oxide synthase trafficking
  Uniprot ID: Q8IVI9
  ENST ID: ENST00000628859
  CDS Start-End: 1-1437

SEQ ID NO: 159579 - DNA, 1749 bp, Homo sapiens
  Payload ID: 11228
  Gene Symbol: NIT1
  Gene Name: nitrilase 1
  Uniprot ID: Q86X76
  ENST ID: ENST00000368007
  CDS Start-End: 383-1321
gcttctggctccagaccgccctccggatcggaccctgcgaatggttttggctatatcttcatgtaggacctactccctatcccgtcggccgcggtgaatcccacctgcggtgctttaacttgtgtaacagagatgctgcctctgggagaggcggggagggacgggccaactggagcgggcggcgggagggtggagggcggggcgcggcttggggcctgggttcctttgccccttgcccaccagggaggggtgggagacgagagagggtgaactttcccctgcgagattctggtgaaaggggaaatatgcttcgagtcagtaaagctgcgcaagtgcacagtcaaggagagagtcttgggaaaaccaaggatagttcccggagatgacttttggactgcggaaacgtttgtcagaggaaagaggcttcagtttaatgcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactc

SEQ ID NO: 159580 - DNA, 2081 bp, Homo sapiens
  Payload ID: 11228
  Gene Symbol: NIT1
  Gene Name: nitrilase 1
  Uniprot ID: Q86X76
  ENST ID: ENST00000368008
  CDS Start-End: 60-791
cttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggagcccgtctcctcttgagggtgacgtagggcagcaggtcgtggcgagtgatgatgcgcagcagctgcagcacctggcgaaagttactttcatcacagcggccctggcgctccagtgccaataagaagtcacgtccatttcggatgagtccacgctcgtggtcatcaatgacatcaacaaagaggaaagaaagcacgcgcacatctctgtgtgtcagatgagtgcccacgatgtcaaacatgcggtgcaggctgtacagcccatgttcctgctcaccatgctcttctggccacacctggcttgcccgccgctttaggcccgccatgctgggggctcaggtacgcaatgctttccagaatccctgctcagcagctgcaatccccaccgtactgaaagggcagggaaagaaccgatgagacactcaagggcaggaactagtctcatgcattcccatattcccagttgctaacaatgcctggcacagtatagtgctttatacatgtttattaaatttttgaagtgtttgtttaaaaataaacactggccaggcacaggggctcacacctgtaatcccagcattttgggaggccaaggcaggaggatcacttgagcccaggcgtttaagaccagcctgggcaacatagggagacccgtttctacaaaaaaagaaaaaattagctgggcttggtggtacacgcctgtagtcccagctgcacaggaggctgaggtgggaggaaggcttgaggccaggagttcaagatcagcctggtcaacatagcaagaccccatctctacaaaaaagaaaaaaattagcaaggcatggtggcatgtgcctgtagtccctgctactcaggaggctgaggcaggaggatcacttgagcccaggagttcaaggctgcagtgagccataatcctgcactgtagcctgggtgacagagtgagtcccccatctcggaaaaaaaagaactagtttaaattctgactgtatcactgaaaggctgtgtagctgtgtgaccgtaagcaagtcacttaactccagattctcagtgctgtcatctataaacagggatgaatgaatatacacctcagagttgttaagaatccaatgagaaaatcacgggtaacccttatataaatggttgtgaaacatttcaaagatacaagcatccttggcctttgcagcccagaatcatccctccacatttttcctacaatccaaccacatcaagaaatgataactgctcagaaagtttatcaatatttaccaaaactcatggatttaaaataaacattaagtttctacaataa

SEQ ID NO: 159581 - DNA, 1362 bp, Homo sapiens
  Payload ID: 11228
  Gene Symbol: NIT1
  Gene Name: nitrilase 1
  Uniprot ID: Q86X76
  ENST ID: ENST00000368009
  CDS Start-End: 77-1060
gcccactcgctgcggcgcttctggctccagaccgccctccggatcggaccctgcgaatggttttggctatatcttcatgctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtc

SEQ ID NO: 159582 - DNA, 1518 bp, Homo sapiens
  Payload ID: 11228
  Gene Symbol: NIT1
  Gene Name: nitrilase 1
  Uniprot ID: Q86X76
  ENST ID: ENST00000392190
  CDS Start-End: 215-1090
cttctggctccagaccgccctccggatcggaccctgcgaatggttttggctatatcttcatgtaggacctactccctatcccgtcggccgcggtgaatcccacctgcggctgggcttcatcaccaggcctcctcacagattcctgtcccttctgtgtcctggactccggatacctcaactctcagtactttgtgctcagcccaggcccagagccatggctatctcctcttcctcctgcgaactgcccctggtggctgtgtgccaggtaacatcgacgccagacaagcaacagaactttaaaacatgtgctgagctggttcgagaggctgccagactgggtgcctgcctggctttcctgcctgaggcatttgacttcattgcacgggaccctgcagagacgctacacctgtctgaaccactgggtgggaaacttttggaagaatacacccagcttgccagggaatgtggactctggctgtccttgggtggtttccatgagcgtggccaagactgggagcagactcagaaaatctacaattgtcacgtgctgctgaacagcaaaggggcagtagtggccacttacaggaagacacatctgtgtgacgtagagattccagggcaggggcctatgtgtgaaagcaactctaccatgcctgggcccagtcttgagtcacctgtcagcacaccagcaggcaagattggtctagctgtctgctatgacatgcggttccctgaactctctctggcattggctcaagctggagcagagatacttacctatccttcagcttttggatccattacaggcccagcccactgggaggtgttgctgcgggcccgtgctatcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactc

SEQ ID NO: 159583 - DNA, 7289 bp, Homo sapiens
  Payload ID: 11229
  Gene Symbol: NIT2
  Gene Name: nitrilase family, member 2
  Uniprot ID: Q9NQR4
  ENST ID: ENST00000394140
  CDS Start-End: 92-922
gacgcggtccccgccccaccgtagcgacgccgcggtccgccggatctccagcgctcagtccgcgccgcaggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccgggctgttgataatcaggtgtatgtggccacagcctctcctgcccgggatgacaaagcctcctatgttgcctggggacacagcaccgtggtgaacccttggggggaggttctagccaaagctggcacagaagaagcaatcgtgtattcagacatagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaagattttttttttaattcggccttgtccttcctaggttctctattgagatgagaaagcctcattatgctgacattttccacgccacattaaatagttaaaaaggatgcagcctggagccagagagcagaaagctgggctggttctgaagcttcttccatacttaagttgcctccaagcagtttgtgaaagtatcagatcttggtatcctggtgattgattcacctaatataaatatatttgtgtcatgaacctcttatcccgttgctggagttgtaatctccatcatctagaaaacgtggtctggtgctattcttttccaagcagtaccttgaagttccatttttggttcatgagtagctatagaacgcaaggtgatacatctttggtgtttgccagagaagttggcagccccacccctcctaccagcctttgcactcttcaaatttaaaaaggagctacttatcaaccccaggcccttctggtcttagaggaaggactgggccaacaaagagcaccatgggagaatggcagtggtggcatttagtgaagacaatttagtatgaatgtctgcaaaagatttttttgatagcgttgagtgtctgaaagtcccattatttttcttttttctttttccccagtaacactttctagctccacggataaggaatcactgaacctagtagttcttagacagcttggtttgagaatccttttgcggttaaaaattagggactgagccaggcgcagtagcatgcgcctgtagtcctagccacattggaggctgaggtaggaggatcccttgagtccacaagtttgagttcagccagagaccctatctcactatatatatgtatctcaaagacttcaatgggtttttgcttacatgggccagtaattgttgaacaaccagctatttgagaaaaagccctgattttgctgcttttcatggtgtaaatacttaaccatggctgagtttgagctatctgcatgacacctctaaacacagagttgggaatagatgtgcacaatcagctctggggagctggtgcaatcctgccctagcacaccactggtttaagatagatatatcatatagatatttaccatttaccatattggaaagtaaaatggagaaaaatttaaaacacaagatacatgagcacacattccattagctattaaggtgatggacacggtgtccaaatgacacggtgtcatttaacttctggaaaacaacactgtgtactgagaacaagagaaagacaaatgacttttttaaattaagtttttaatttacaattgatgcataattttactttaaaaaaataagtgtgcaatttggtaaactttgacatatacagctataaaccactccaatcaagataacatatttaccacccccaacagtttccatgtgctgtattataatccctctggctagtcctttgtcaatcactgataaattttattactatagattagcttgcattttctaaaattatataaaaatgaaatcatgccattagtgctttttctgtatgtcttctttcactcaaaatcacttggaactcaaaattacttctttcactcaaaatcactcaaaattacatactctgtatgtcttctttcactcaaaattacttctttcatttttagacggaagcatttagacctcaaaattacttggagattcatctggtatgtgcattaataattcataattcattccttttttattgctgagtagtatacaatttgtttatccatttatctgctgttggagatttgggctatttccagattttggctgttgcaaaaaagcaacctcacagatccttttaaaggatgtcaggtgctttcaggtaaccctagactatagtaccactgctctctatcctagcaggcacactgaaagttaaaccttgtaatagtgcgaaatcattttcttttttaaaaatatattttcttacttttatatattttactcaatctcatgacagattacattttcttttttaaatagaaagtcttactgtaaagcccacatctgtataaaaaaatgaaagaatgatctggttgatgtggatgtgtggaacctaggaaccttctcttggattttctcttattccccaaaaaacttcatttcctctaaagagctgctcagaagtttgaaaaccagtggacaagccatcctagctgtcttgatgctagagaagcaaagacgctttacagagatgtagcattcctgtaacaggtaaggcaggtggatgctaaactttttacatttcttttttttttttttttttttttgagacagagtcacgctgtcgcccaagctggagtgcagtggcatgatcttggttcactgcatcctctacctccttggttgaagcaattctcaggcctcagcctcctaaaagtagctgagactacaggcacgtgccaccatgcctggctaatttttgtgtttttagtagagatggggtttcaccatcttggccaggctggtcttgaactcctgacctcaagtgatccacctgccttagcctcccaaaatgctaggattagaggcgtgagccaccgcgcccggcctaatttttgtatttttagtagaaatggggtttcaccatgttggccagtctgatctcgaactcctggcctcaagtgatccaccagccttggcctccccaaagtgttgggattacagacgtgagccacggcacccagccttttgtttgtttttgtttttatgtatttcattaaatgaattgtccttttagtggtatatcaggagatcttgccttctggtactcttgaaaaatatgaaaagaaacaactgaagtaggcatctcctataattagtatgtagcattttattctcagaaaatgtgtggtaacctggccctggattttacctttttgcaaagtgatatccgaataaaatgaacactagattcccacttggagtggaagaacattgcagttgaggccttgggtaagttttaactgccatacccctgtactccccgactttctaatgaattagacaatgatgttttatttttgttttttgtttttgcataatactttgaagtctgctatcacaagttgtgaacctctatctcttgcagtttaggtaaggcaacacatttaatgaattcacatttaagtgaattcctcacagggatgacgacctctgttgaaataggtcaggatgtgcagtttgtggtgaaagttctacttgactttgacctagctgtttgaagctgagagctaacagataataagtgttgcactggttgcaaatgaataaataagtaacattatggggttttaaatgaccaaggagtagattgtgacatcgactgggtatttagggaaggactccttcctgataccaaaagttaggtctgtgcaaagtacaccaagtggaaaaaagtttagacaagagtttaggtttcaagataaatgttctgctctattggcactggttttaagtcttttgtgctactttttaggcattgctgtgtaagttttggtggtgcgtgggtacaatgaagccaggagggatagaaagggaaatgatgtgtgtgctgcaggctaaacaggggctcttccttatgcctcataaccacctgtgtgtgacagtttcacatttcctatcaaattattatcttcattcatttctacttgtgaatgaagttcggagactaagaaaaagccagctgttggaatagaaagcactttaggataaaatggtcttgttaaaatcaccaattaaaaagttaagcccctgatgtacaaataactaaaacacatacatacaaagacagtgcttcttgttcaatgatttacttcacagctgattcataatcaaatgaacaagaatctgcaagaacagaacatggtgggcagggtccagtaattccaaatgttgtcatcctagctcttcctgaagcatattgaatcctccaagtatatcccgttgtgctaactaggctttaagtcttttgtctgtagattcattctcaaagtttctccctcagaacaaagagcacgccatcctgtaaagtactcttcctgattttttttcacccaatttcttagtttctttcaattgcttttcagaccccggcaggcagattctgccctcatctgtccagtgacactcttctggcagattactaaagaccgatttgtagacctgtccatgtggcctctctcaacaccattggtgtgaccttgctcatactgcctctctcaccacttaacattgtcccttagatgttaaaggcccttatattaatagttttattttagctcctttacattttattttgtcctgaggaatctcagctacatgcatggtcttcaatatatgccgataattctcattcacatagctctcctgttggcttttccccactcgtttaaaaacaaccacttcactttgctggactctaccttgaatgcctcattttcagctcacactcatgctgtgcctttatttagatttgttgtggttgtttccccacattctggaagctccttacctaaatcctgtttattccttaatgcttagcacaatttattactcttgtttccatggcactacattgtacttctgttttagagactaccttcctctgaagcatatgacaggttcatttactatccagcccaccaaaactcagtttttgagctcctctatgttcatctttttatggctaaccctcaccatcatgagtgcttagtaaatgttgagttggaatgaatttattcctacaggttgcacttgctctctcaccaagtgttctggccaaataattctggaatgatttccttaccttaagggagtctgatctgggaagagcctgggacgtgatgtaacttcatatgctgtagagctgaatattcatttacttaagatcttagctccattagaaagcagtgaaagcagtgttaattcagaggccgggtatggtggctcacgcctgtaatcccagcactttgggaggccaagatgggcagatcacttaaggtcaggagttcaagaccagcctggccaacatggcaaaaccccatctctactaaaaatacaaaaattagccgggtgtggtggcacatgcctgtgatcccagctactcgggagggtaaggcaggaggaggttacagtgagccaagatcacaccactgtactcctgggcaacagagttaaactgtatcaaaaaaaaaatgcagtattgatttagagctaaggtcacctgatgctcaggccagtaatttctccctgcatcatgctgttgtctaaggcagacactgtaaagctctacactgctgaaaaactaagcttgagatgcataaaagaacacatagagatggggagtcagttctccatacattttgtgagtagaggcattggtgttttgttccaaactatccaatcgagaatgttcatataatgacagctttggaaggtagagactatcttcctctggatcataggacaggtttgtttactatctgatacagtcaaaatagtgtttccctctaatgcgaaagtcaggccagtttgcttgtgacctcattagatttgggctgtgacgcaaacccactgcatgtgcagtatccacctagcttgccctgtgtcactcccatgggatctgtggctcaaactcatgttgcttgctatgttctaaataattaagtctgttgtctgacccaggagtctcatgtcttctgccagcattcagaaaactagttttcaagaagggtaacatcttagaccttttacagctcttgacacagagcaatattgagaaataaaatcaggtaaaagttatttaatatagcagttcataatttaggccatggatcatctctgcagagaatcctaccatgctgcattcttgctttaaacctttcgccctctaaaacaatgcccaagagccaatgttagtcatggtcttcctgtatttgctctaggtaagctgtttcatagccttccaggacaacacttgcacaggttatctttaagcaccaacaaaagaaatggagaaatttgagccatgtatcctgagctctgaaaggcagcaatcatcttgaccccaagcatacaccatgttcagcttcctccccttggccaggtaccacagctacttctatcccagtgatcagcaggccctccagcatgaagacctttgagaaggatctatagctgtcaactcctaatatgatttgtgcactatcaccttgaagtaaaccagactagttattttcatgctaa

SEQ ID NO: 159584 - DNA, 625 bp, Homo sapiens
  Payload ID: 11229
  Gene Symbol: NIT2
  Gene Name: nitrilase family, member 2
  ENST ID: ENST00000480073
  CDS Start-End: 23-301
ggtggtgcttgtctgcagagtcatgacctctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggtaacttcctacccacaaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggctgccagctgttggtatatccaggagcttttaatctgaccactggaccagcccattgggagttacttcagcgaagccg

SEQ ID NO: 159585 - DNA, 795 bp, Homo sapiens
  Payload ID: 11229
  Gene Symbol: NIT2
  Gene Name: nitrilase family, member 2
  ENST ID: ENST00000497785
  CDS Start-End: 1-795
gccgcgcgctgcagctcgagttcgggccgcgggggaggctttggagcggcgccggcggtggctcggccggctcagcccctccgccccgcgtccccgccgtgcgcggccttccctgaggcgggcgtccgcgtgggtccgggatcgcgtggccgggcggccgggcgcactcccgggattccaggcttccggggtggcgggcgaggcccagaaagcaccaggccacccggccgcgccggcacccgccgcgtcctgcttgacagaggctgatggacgtgtatttctccacgctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaactttactagcaaagtatagaaagatccatctgtttgacattgatgttcctggaaaaattacatttcaagaatctaaaacattgagtccgggtgatagtttctccacatttgatactccttactgcagagtgggtctgggcatctgctacgacatgcggtttgcagagcttgcacaaatctacgcacagagaggtgaggcagt

SEQ ID NO: 159586 - DNA, 648 bp, Homo sapiens
  Payload ID: 11229
  Gene Symbol: NIT2
  Gene Name: nitrilase family, member 2
  ENST ID: ENST00000460317
  CDS Start-End: 17-151
gcttgtctgcagagtcatgacctgtaagtggcgcggccgcgcgctgcagctcgagttcgggccgcgggggaggctttggagcggcgccggcggtggctcggccggctcagcccctccgccccgcgtccccgccgtgcgcggccttccctgaggcgggcgtccgcgtgggtccgggatcgcgtggccgggcggccgggcgcactcccgggattccaggcttccggggtggcgggcgaggcccagaaagcaccaggccacccggccgcgccggcacccgccgcgtcctgcttgacagaggctgatggacgtgtatttctccacggtgtgggccgcggtgctttccgcttggccctcatccagcttcagatttcttccatcaaatcagataacgtcactcgcgcttgtagcttcatccgggaggcagcaacgcaaggagccaaaatagtttctttgccggaatgctttaattctccatatggagcgaaatattttcctgaatatgcagagaaaattcctggtgaatccacacagaagctttctgaagtagcaaaggaatgcagcatatatctcattggaggctctatccctgaagaggatgctgggaaattatataacacctgtgctgtgtttgggcctgatggaacttta

SEQ ID NO: 159587 - DNA, 1236 bp, Homo sapiens
  Payload ID: 11230
  Gene Symbol: NKX1-1
  Gene Name: NK1 homeobox 1
  Uniprot ID: Q15270
  ENST ID: ENST00000422806
  CDS Start-End: 1-1236
atggacgggcgcgccgagctgccggcctttccccgcgctggagccccgccgctcgcggccagcgacactgtgcctgcggcgcccgagggggctggagcggcccggcccgcagcgcccctgcgccccacctccttctcggtactggacatcctggaccccaacaagttcaacagcaggaggcgtcgttgcgtgctgctgggcccagtggctcccgctgcgtgcgccccttgcgcttcggccccatgcgcccctgcacccgccgcctcgggacgcccgccacgcgcggaggagctggagcgccgcgccctcgccggcgccgggggagtcggagccgccggagctgagccgccgaacgccggcgaccccttcaaggcaggggaggccgagaccaacgacaccaacggctacagcagcggcggcggcggccacagcccgagcgcggacagcggggacgaggttcccgacgacgaggacgacgacgaggacgaagcgcccgagacggaggcggcgcgaggcgcggaggaggcgcggggaggcggcggcggcctcggggcccgcgggtcgggttgccagggcgcggctgagaccgacgcgtcccccggagccaccgtcgacgaggcagcggcccccggaccccgcgagaactcgcccgttgcccagggcccaccgggaggtgcagcggcgccggggggcgcggggaccaccccgcagggcacggcgacggcggcgaagcccaagcggaagcgcacggggtccgactccaagtccgggaagccgcggcgagcgcgcaccgccttcacctacgagcagctcgtggcgctggagaacaagttcaaggccacgcgctacctgtcggtgtgcgagcgcctcaacctggcgctgtcgctcagcctcaccgagacgcaggtgaagatctggttccagaaccgccgaaccaagtggaagaagcagaacccgggcgccgacaccagcgctccgaccggcggcgggggcggaccgggaccgggggccgggcctggcacggggctgcccggcggcctcagcccgctcagcccctcgccgcccatgggcgccccgctcggcatgcacggcccggccgggtacccggcgcacggccccggaggcctggtgtgcgccgcgcagctgccgttcctgtcgagcccggcggtgctctcgcccttcgtgctgggctcgcagacctacggggcgcccgccttctacgcgccgcacctctga

SEQ ID NO: 159588 - DNA, 3364 bp, Homo sapiens
  Payload ID: 11231
  Gene Symbol: NKX1-2
  Gene Name: NK1 homeobox 2
  Uniprot ID: Q9UD57
  ENST ID: ENST00000451024
  CDS Start-End: 242-1174
gcggccgcggcacagcgcctgatagtcccgaggctggcccgggctgcgccggtgccaatcggcgcgcagccccccgcggcgctctccccgccccgcctccccgcccccctccccagcttcacttggcagcgcggacccggctcctggctggaaagctaccgccaagccacagccgaaggcaagcccgagcggcgccatccccaaccccgcgccgccgaccgccggcccgtgggcgacgggcatgctggcatggcaggacggcggggccaaggcggctccctcccaccacaagatttctttctctgtcctggacatcctggacccacagaaattcacccgcgcagcgctccctgccgtgcgcccggctccccgggaagccaggaaaagtttggcggaggtcgaagcggggaaagatgccagctccagggaccctgtccgacagctggagacccctgatgctgcgggcccaggcgccggccaggcgtcccccctggagggttccgaggcggaagaggaggaggatgcggaggatccgaggaggccgcggctgcgggagcgggctgcgcgcttgctgccgggcctagcgcgctcacctgacgccccggccggggcattggcgtctggggagccctgcgaggacggcgggggcggccctgtgaggtcccccccgggatcccccggctccccgcgtcccaggcgccggcgcctggagcccaactgcgccaagccgcggcgcgcgcgcaccgccttcacctacgagcagctggtggccttggagaacaagttccgggccacgcgctacctgtcagtgtgcgagcgcctgaacctcgcgctgtctctcagcctcaccgagacgcaggtcaaaatctggttccagaatcgcaggaccaagtggaagaagcagaacccgggtgccgacggcgcggcgcaggtggggggtggcgcgccccagccaggggcggcggggggcggcggcggcggcggctcggggggcagtcctggccctcccggcaccggcgctctgcacttccagactttcccctcctactccgcggccaatgtcctcttcccgtccgccgcctccttcccgctgacggctgccgcccccgggagccctttcgcgccgttccttgggccttcctacctgacccccttctacgccccgcgtctatgaatccggagccccctggcccctctttcgcgggattcacgagggattggcatcgtcgtgtgccctcggctcctccaccgggggtgcaggtgcgcgggtgtcagcgcacccctgcccgccgcgcgcacccgcgatcctcgcgggccaccaaggggtcagggatctgccgtccttcaaagtgtccggggacggaggctgacctcaagccttgccgtttctggaccttgctgttcactttgggtcaggtttaattcagttcaggggctagtttttgagggtctgggtgttcggcgcggggctaaccaagatgccaggagggaaatacagggagcagagacgccctggctgccagctgctggcggctaggatggaacctttaaaggtgctggctcatcagagggtgagaaacagtctctgttcacaactgacagcttcccctcctcgtgctcgatggttcagcccaaacccagagagttcttccaaatcctgaacgaggctggggagagcttggtcctggagcacagacggccgctctgaaacggactatttttaaaatgcataaaactccacatttctagatctttacttaagattcggactggaacacaatacttgttccaaataacctccccaggctattcctgagagagggggtaccttggtttttggagtaggccagaagtttgtggtaggaaaggtgactgatttgcagctagactcacctgctaaagtagacacgggtctgttgcactgcaggttttgagaacagcctggaccaaaccacacagtgaccccaaaggcataaaaatgataatgaaggcagcgatggctcaactaatatcatgaagtctatgcatgaggctgcctactttgatttgcagtagttgatactttaaaacttcagtcctggcttatctgcctgtcccagggattcctgggctcccaatagtgagccaggatggggaagagctagctccatcagcacacactacatgtggacagttggactggactgttttttaaaagcacaaactcaacatttttagatcttcgtctaggattctgacttgaaaacaattcttgttacaaacagactctttatggtggtgaacaagcagagattgtaagggcccatgaaagcaatacttgggtgtgaagagccgtcatattcctaatggattcacctccaggaatctgatacatggacatgcattttaactgctgcttttattacctcccttaaaaaattagttctgtgaaattcccttgccacttttgcttggaatacatttcctttagttttctacctaatataatcttgtagcccacgtctcagaaacccagaggtccccagttgtgtcatgtatgtttcattctcacttttgattacttgaggccagccgagatctgtgtggataccatattccttgctattttttggtagcctgtgctactaacaatcaaatttaatggtcaatggcttcaaagtaaagcaccctgtttggtattatggattacattccatgactatgatcttgaaatatctagttctgttatcaggaatgatagaaaatattccccatttctcctaaattaagtgaagacttcatggttcatgtgactctcataatatttgatagtatgtattatttaattacttaatatccactaattagactcttttccttctaaagaagaatgtcccccaaacaacacattgtaactttctaaaagacagttggtgccagatgagattaaaaatgcagttactctactagataatattcaccttacacttcggtaaacactcctttaataactatttgttggtttctcaaaagcaatatcccatattaaacagacaattcaaatgtgacaattcctctgtaacaaagaagctgaattctgtaataaatgggaaacatttcattccagtcttctcaggtaccagaatcatggacttcagtagaagagagggaatagggagagaggtgggaggctgatctgttcgtggcccagcacggtgctgtaattcctgacccttctggtttccacagatcattgcagagtaatgcttgaagcgtgtgactttggacttctgctgctttaaaaggcccagtggctttccaaccaaatccttagactcaatctattggtgtgtttgtctaataaattctttttgtagtaaattta

SEQ ID NO: 159589 - DNA, 2191 bp, Homo sapiens
  Payload ID: 11232
  Gene Symbol: NKX2-1
  Gene Name: NK2 homeobox 1
  Uniprot ID: P43699
  ENST ID: ENST00000354822
  CDS Start-End: 100-1305
agactgacagacacgtagaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggtttttttttttaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggatttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaccctc

SEQ ID NO: 159590 - DNA, 2583 bp, Homo sapiens
  Payload ID: 11232
  Gene Symbol: NKX2-1
  Gene Name: NK2 homeobox 1
  Uniprot ID: P43699
  ENST ID: ENST00000518149
  CDS Start-End: 607-1722
agcaacgcgggggacacccccgattccgctggggagcgcagcccacagctccccctcgccaggcgcccaaggaccctcaaggcgcggggcccacacttgaagcctgggaacgcgcagacaggaaaccctcttcctcctaagcagtttcttgctcgtcggatgagaggcgcccaattgaagcagaatgatcctcatctactaatatccagcgtggccacaaagcgactggccatttacgccaccactttaaacaaagatatttggttattcccgggaagcaagagcacttttgcatggctgagctgcgggcggaggcgagcctcggcccagcctcccgcccgctgagctgcccgcacctcggcattcgccccctcctggccagcgctccagccgccggggttcaggctcagttccgcccggcaacagacagacgggcactcacgccgctccctgctcgcgcgctccctgaagcatcagaggggaaaacagcgtggctctgggctcgggtgctggggctgtgatgtcctcggaaagtcagctccagccccagatccccgcgtgtctgggagatgggcgagggtcagggacaccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggtttttttttttaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggatttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaa

SEQ ID NO: 159591 - DNA, 1417 bp, Homo sapiens
  Payload ID: 11232
  Gene Symbol: NKX2-1
  Gene Name: NK2 homeobox 1
  Uniprot ID: P43699
  ENST ID: ENST00000522719
  CDS Start-End: 241-1356
gcccgatgtggtccggaggcagtgggaaggcgcggggctgggaggccgcggcgggagggaggagcagccccggcaggctcagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccac

SEQ ID NO: 159592 - DNA, 2338 bp, Homo sapiens
  Payload ID: 11232
  Gene Symbol: NKX2-1
  Gene Name: NK2 homeobox 1
  Uniprot ID: P43699
  ENST ID: ENST00000498187
  CDS Start-End: 337-1452
ttaaaggtgtttaccttgtcatcagcatgtaagctaattatctcgggcaagatgtaggcttctattgtcttgttgctttagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaaggtaacaccagaatatttggcaaagggagaaaaaaaaagcagcgaggcttcgccttccccctctcccttttttttcctcctcttccttcctcctccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggtttttttttttaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggatttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaccctc

SEQ ID NO: 159593 - DNA, 653 bp, Homo sapiens
  Payload ID: 11232
  Gene Symbol: NKX2-1
  Gene Name: NK2 homeobox 1
  ENST ID: ENST00000546983
  CDS Start-End: 551-653
aatatccagcgtggccacaaagcgactggccatttacgccaccactttaaacaaagatatttggttattcccgggaagcaagagcacttttgcatggctgagctgcgggcggaggcgagcctcggcccagcctcccgcccgctgagctgcccgcacctcggcattcgccccctcctggccagcgctccagccgccggggttcaggctcagttccgcccggcaacagacagacgggcactcacgccgctccctgctcgcgcgctccctgaagcatcagaggggaaaacagcgtggctctgggctcgggtgctggggctgtgatgtcctcggaaagtcagctccagccccagatccccgcgtgtctgggagatgggcgagggtcagggacaccagggggaaagggggcggggagcagaggtgtccctctgacggcggcagaagagaggcagacagactgacagacacgtagaccaacagtgcggccccagggttcgtccccagactcgctcgctcatttgttggcgactggggctcagcgcagcgaagcccgatgtggtccggaggcagtgggaaggcgcggggctgggaggccgcggcgggagggaggagcagccccggcaggctcagcgcttacgccccgcctctggtggctg

SEQ ID NO: 159594 - DNA, 2092 bp, Homo sapiens
  Payload ID: 11233
  Gene Symbol: NKX2-2
  Gene Name: NK2 homeobox 2
  Uniprot ID: O95096
  ENST ID: ENST00000377142
  CDS Start-End: 358-1179
gcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaagaaaaaa

SEQ ID NO: 159595 - DNA, 2097 bp, Homo sapiens
  Payload ID: 11234
  Gene Symbol: NKX2-3
  Gene Name: NK2 homeobox 3
  Uniprot ID: Q8TAU0
  ENST ID: ENST00000344586
  CDS Start-End: 200-1294
agtccctgcagtggctgtaacaaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattatttggactggacaattaagtggccctgatgatgttaccaagcccggtcacctccacccctttctcagtcaaagacattttgaatctggagcagcagcaccagcacttccatggtgcgcacttgcaggcggacttggagcaccacttccactctgcgccctgcatgctggccgccgctgaggggacgcaattttctgacggaggggaggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaaaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagcgcacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatgtacgtctagctcctcagggcttcggatcgcagctcactcgaggcctggggaaggggactcaggggcgaggaggatgactgggtccggtcgccaggactgtctctgaggcagaaacgccggctgggcgccggggaggacgatggccccgaccctggcagcgagaggagaccaggaggctaggaccctggccgcgcttggttcttccaaagcgagaagggcttctctccctctgcctttccgcggcctccgcgaagcgttggcggggagcccaaggacataacaaattaaaagcatgaaggagagaaaaatgggggtcgtggcttgagaaattccaggccctaccgatcctctgccccctttgcgggcctggagcgccatagcacagtcgatttcgtttcgcagctgtctcccctccgcagcagatacctcggtccagatctccggattgtcgggggacgcaggactcttcgaggaaaaccagccgaatgagatcaaaagttgggggtggggggaggctgaacaaactcaggacctggtggcccaccggaggtgttaccgggtttcctttctgtttcgtattctgtattcagcacatgttatctatctatctatctatataactataaccacacgccgtgtagacacccgctgccacacactacaggagtcaataaacaaggtgcaatattttcaaa

SEQ ID NO: 159596 - DNA, 1986 bp, Homo sapiens
  Payload ID: 11234
  Gene Symbol: NKX2-3
  Gene Name: NK2 homeobox 3
  ENST ID: ENST00000622383
  CDS Start-End: 180-1070
caaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattatttggactggacaattaagtggccctgatgatgttaccaagcccggtcacctccacccctttctcagtcaaagacattttgaatctggagcagcagcaccagcacttccatggtgcgcacttgcaggcggacttggagcaccacttccactctgcgccctgcatgctggccgccgctgaggggacgcaattttctgacggaggggaggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaaaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggcggcggcggcggcgggacctccgcggcgaccactgccatgcagcccgcctgcagcgcggccggaggcggcccctttgtgaacgtgagcaacctaggaggcttcggcagcggcggcagcgcacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatgtacgtctagctcctcagggcttcggatcgcagctcactcgaggcctggggaaggggactcaggggcgaggaggatgactgggtccggtcgccaggactgtctctgaggcagaaacgccggctgggcgccggggaggacgatggccccgaccctggcagcgagaggagaccaggaggctaggaccctggccgcgcttggttcttccaaagcgagaagggcttctctccctctgcctttccgcggcctccgcgaagcgttggcggggagcccaaggacataacaaattaaaagcatgaaggagagaaaaatgggggtcgtggcttgagaaattccaggccctaccgatcctctgccccctttgcgggcctggagcgccatagcacagtcgatttcgtttcgcagctgtctcccctccgcagcagatacctcggtccagatctccggattgtcgggggacgcaggactcttcgaggaaaaccagccgaatgagatcaaaagttgggggtggggggaggctgaacaaactcaggacctggtggcccaccggaggtgttaccgggtttcctttctgtttcgtattctgtattcagcacatgttatctatctatctatctatataactataaccacacgccgtgtagacacccgctgccacacactacaggagtcaataaacaaggtgcaatattttc

SEQ ID NO: 159597 - DNA, 2238 bp, Homo sapiens
  Payload ID: 11235
  Gene Symbol: NKX2-4
  Gene Name: NK2 homeobox 4
  Uniprot ID: Q9H2Z4
  ENST ID: ENST00000351817
  CDS Start-End: 630-1694
tttaacactttaggtgatggagcgaatgaggggctgataactggagaggacgaagcaagcccccgcaacaccctccccccaaacttagcagcacgttccccattccgcaattataccggactttggtgcgaagtcactttagaaaactgggatctggaaggggccaggcgcggagtccatgtctagcctcgacgccagcctccgagtttctatttctggtgctcgagggctggggtaacggccgcggatggaggagcgaaggatgggaaaagcaaaggatgggaaaagcaaagatgggaaaagcaacggggagtgatctttccaagaaacacccaactgccccttttacctttttttgcctccattatggggcgggggttgggggggcgagagaaaaagatgtcaatgaccattgtttgctcgtttgggatgttgctccgccccccgagtctgtcgtaaacctggcgccggactaaaataaaccccagatcccgcagcccggggggctcgccgagccgccgactcctcgtcacaggctcagctgccgcggccgaggtggcggcgacgagcggccgccgcgtcctgccggcgcgcgccccaggcccccctacctggctgcccgccgagccatgtcgttgagcccaaagcacacgacgcccttctccgtgtccgacatcctgagccccatcgaggagacctacaagaagttcagcggcgccatggacggcgcgccacccggcctgggggcgcccctgggggccgcggccgcctaccgcgcgccgccacctgggccctcctcgcaggcggcgaccgtggcgggcatgcagccttctcacgccatggcgggtcacaacgcggcggccgcggcggcggcggcagcagctgcggcggcggcggccgccacctaccacatgccgcccggcgtctcgcagttcccgcacggcgccatgggcagctactgcaacggcggcctgggcaacatgggcgagctgcccgcctacacggacggcatgcggggcggcgcggccaccggctggtacggcgccaacccggacccacgctactcgtcaatctccaggttcatggggccgtcggcgggcgtgaatgtggccggcatggggtcgctgaccggcatcgcggacgccgccaagtcgctgggcccgctgcacgcggcggcggcggcagccgctccgcgaaggaagcgccgcgtgctcttctcgcaggcgcaggtctacgagctggagcggcgcttcaagcagcagaagtacctgtcggcgcccgagcgcgagcacctggccagcatgatccacctgacgcccacgcaggtcaagatctggttccagaaccaccggtacaagatgaaacggcaggccaaggacaaggcggcgcagcagctgcagcaggagggcggcctgggcccgccgccgcctccgccgccgtccccgcgccgcgtggcggtgcctgtgctggtcaaggacggcaagccgtgccagaacggcgccagcacgcccacccccggccaggccggtccgcagccgccggccccgacgccagcacctgagctggaggagctgtcgcccagcccacccgcgctgcacggcccggggggcggcctggcggccctggacgcggccgccggggagtacagcggcggcgtcctgggcgccaacctgctctatggcaggacgtggtgacagcgagggcgccccggggctaggtcctggtgcacccgaagggtctgcaagaaactgctagaacggatgggggaggcatgcgaaaaccgactcgcgcgtgtaaactgcgattcaaaacgaaccggtctcagagaggagcaggctgtgaacctcttgctgggggcgggggacagcgacagcccggaaaccgagtagtgtaacattatgccacgaggctttgaggtggtgattttctcctcctagaagttcttaaatgacgcgaaaaggtggagaagttcacacggcattcttaactacagctctcaaagttggaaactttgttggcgtttgtaactataaaaatcaacccagctttaacaatcagtcctttttgaagtggaatttatcttgggagattaattttcgaagggccccctaagtgcaatttcattaatgtttgattgaaagtaaattgaagtgtagctcaaggtggatcatacacatagcaacattattgcagaggaattattgccatttaggtaatagagcaatggaatcaaaataa

SEQ ID NO: 159598 - DNA, 1709 bp, Homo sapiens
  Payload ID: 11236
  Gene Symbol: NKX2-5
  Gene Name: NK2 homeobox 5
  Uniprot ID: P52952
  ENST ID: ENST00000329198
  CDS Start-End: 275-1249
tttttttgccgtatgactatattaggtgacacgaaactgctcatcgctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcaggatcgcggtgccagtgctggtgcgcgatggcaagccatgcctaggggactcggcgccctacgcgcctgcctacggcgtgggcctcaatccctacggttataacgcctaccccgcctatccgggttacggcggcgcggcctgcagccctggctacagctgcactgccgcttaccccgccgggccttccccagcgcagccggccactgccgccgccaacaacaacttcgtgaacttcggcgtcggggacttgaatgcggttcagagccccgggattccgcagagcaactcgggagtgtccacgctgcatggtatccgagcctggtagggaagggacccgcgtggcgcgaccctgaccgatcccacctcaacagctccctgactctcggggggagaaggggctcccaacatgaccctgagtcccctggattttgcattcactcctgcggagacctaggaactttttctgtcccacgcgcgtttgttcttgcgcacgggagagtttgtggcggcgattatgcagcgtgcaatgagtgatcctgcagcctggtgtcttagctgtccccccaggagtgccctccgagagtccatgggcacccccggttggaactgggactgagctcgggcacgcagggcctgagatctggccgcccattccgcgagccagggccgggcgcccgggcctttgctatctcgccgtcgcccgcccacgcacccacccgtatttatgtttttacctattgctgtaagaaatgacgatccccttcccattaaagagagtgcgttga

SEQ ID NO: 159599 - DNA, 1124 bp, Homo sapiens
  Payload ID: 11236
  Gene Symbol: NKX2-5
  Gene Name: NK2 homeobox 5
  Uniprot ID: P52952
  ENST ID: ENST00000424406
  CDS Start-End: 182-520
ctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagcctgaaattttaagtcaccgtctgtctccctcaccagggtgtgaactgccccgagggcagagacctcccgttttgttctccagcgccttgagccagcctgactttctacaaatgctgagtgagacgtgtcggtggctcccagtgcacttggcagagtgagccgcagccagctgggcgctccaggcaggacacagtggcctccacgaggatcccttaccattactgtgcggccgcgctccgtaggtcaagccgctcttaccaagcgtctctctgcctctctgttccccctcagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgcagg

SEQ ID NO: 159600 - DNA, 1027 bp, Homo sapiens
  Payload ID: 11236
  Gene Symbol: NKX2-5
  Gene Name: NK2 homeobox 5
  Uniprot ID: P52952
  ENST ID: ENST00000521848
  CDS Start-End: 124-579
acatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagggtgtgaactgccccgagggcagagacctcccgttttgttctccagcgccttgagccagcctgactttctacaaatgctgagtgagacgtgtcggtggctcccagtgcacttggcagagtgagccgcagccagctgggcgctccaggcaggacacagtggcctccacgaggatcccttaccattactgtgcggccgcgctccgtaggtcaagccgctcttaccaagcgtctctctgcctctctgttccccctcagagctgtgcgcgctgcagaaggcggtggagctggagaagacagaggcggacaacgcggagcggccccgggcgcgacggcggaggaagccgcgcgtgctcttctcgcaggcgcaggtctatgagctggagcggcgcttcaagcagcagcggtacctgtcggcccccgaacgcgaccagctggccagcgtgctgaaactcacgtccacgcaggtcaagatctggttccagaaccggcgctacaagtgcaagcggcagcggcaggaccagactctggagctggtggggctgcccccgccgccgccgccgcctgcccgca

SEQ ID NO: 159601 - DNA, 655 bp, Homo sapiens
  Payload ID: 11236
  Gene Symbol: NKX2-5
  Gene Name: NK2 homeobox 5
  ENST ID: ENST00000517440
  CDS Start-End: 229-655
ctcctgtcatcgaggcccctggcccaatggcaggctgagtccccctcctctggcctggtcccgcctctcctgccccttgtgctcagcgctacctgctgcccggacacatccagagctggccgacgggtgcgcgggcgggcggcggcaccatgcagggaagctgccaggggccgtgggcagcgccgctttctgccgcccacctggcgctgtgagactggcgctgccaccatgttccccagccctgctctcacgcccacgcccttctcagtcaaagacatcctaaacctggaacagcagcagcgcagcctggctgccgccggagagctctctgcccgcctggaggcgaccctggcgccctcctcctgcatgctggccgccttcaagccagaggcctacgctgggcccgaggcggctgcgccgggcctcccagagctgcgcgcagagctgggccgcgcgccttcaccggccaagtgtgcgtctgcctttcccgccgcccccgccttctatccacgtgcctacagcgaccccgacccagccaaggaccctagagccgaaaagaaagcacaacttgccggcgcggccagggcggagaggttccctcgtggaaaagttaggaaatgctgcgctaccgcgggcacaagggagtggacgagat

SEQ ID NO: 159602 - DNA, 906 bp, Homo sapiens
  Payload ID: 11237
  Gene Symbol: NKX2-6
  Gene Name: NK2 homeobox 6
  Uniprot ID: A6NCS4
  ENST ID: ENST00000325017
  CDS Start-End: 1-906
atgctgctgagccccgtcacctccacccccttctcggtcaaggacatcctgcgactggagcgcgagcggagctgccccgcggcttcgccacatccgcgggtgcggaagagcccggaaaactttcagtacctgagaatggacgcagagccgcgagggtcagaggttcacaacgctggtggcggcggcggtgacagaaagctggatggttcggagcctcctgggggtccctgtgaggcagtcttggagatggacgcggaacggatgggggagccacagcccggcctgaacgcggcctcgcccctcggcggcgggaccagggtgccagagcgcggcgttggcaacagcggcgacagcgtgcggggtggccgctcggagcagcccaaggcgcggcaacgacggaagccgcgcgtgctcttttcgcaggcgcaggtgctggccctggagcggcgcttcaagcagcagcggtacctgtcagcgcccgagcgcgagcacctggccagcgcgctgcagctcacgtccacgcaggtcaagatctggttccagaaccgacgctacaaatgcaagagacagcgccaggacaagtcgctggaactggctggccaccctctaacgccgcgccgagtagctgtgcccgtcctggtgcgcgatggcaagccctgcctgggccccgggcccggcgcacctgccttccccagcccctacagtgcagcagtgtcgccctactcttgctacggaggctacagcggagcaccctacggcgcaggctacggcacctgctacgcgggcgcgccctcgggtcctgcgccacacacaccactggccagcgcgggcttcggacacggtggccagaatgccaccccgcagggccatctggcagccacgctgcagggtgtcagggcctggtga

SEQ ID NO: 159603 - DNA, 1261 bp, Homo sapiens
  Payload ID: 11238
  Gene Symbol: NKX2-8
  Gene Name: NK2 homeobox 8
  Uniprot ID: O15522
  ENST ID: ENST00000258829
  CDS Start-End: 219-938
attcaggtacttaacaccctggagacccggacctcggctttcaaagcggcctgggtgggaagagctgtttatataaacagagattccgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctagatttacccgagcaggacgcgcaacacctgccgaggcgggagccagaaccacgcgccccccagcccgacccctgcgccgcctggctggattcggagcgcggccactacccttcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgta

SEQ ID NO: 159604 - DNA, 3271 bp, Homo sapiens
  Payload ID: 11239
  Gene Symbol: NKX3-1
  Gene Name: NK3 homeobox 1
  Uniprot ID: Q99801
  ENST ID: ENST00000380871
  CDS Start-End: 39-743
ccgggcgggtgcattcaggccaaggcggggccgccgggatgctcagggttccggagccgcggcccggggaggcgaaagcggagggggccgcgccgccgaccccgtccaagccgctcacgtccttcctcatccaggacatcctgcgggacggcgcgcagcggcaaggcggccgcacgagcagccagagacagcgcgacccggagccggagccagagccagagccagagggaggacgcagccgcgccggggcgcagaacgaccagctgagcaccgggccccgcgccgcgccggaggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattcctccagtgcatactgtaggtcattttttttgcttctggctacctgtttgaaggggagagagggaaaatcaagtggtattttccagcactttgtatgattttggatgagttgtacacccaaggattctgttctgcaactccatcctcctgtgtcactgaatatcaactctgaaagagcaaacctaacaggagaaaggacaaccaggatgaggatgtcaccaactgaattaaacttaagtccagaagcctcctgttggccttggaatatggccaaggctctctctgtccctgtaaaagagaggggcaaatagagagtctccaagagaacgccctcatgctcagcacatatttgcatgggagggggagatgggtgggaggagatgaaaatatcagcttttcttattcctttttattccttttaaaatggtatgccaacttaagtatttacagggtggcccaaatagaacaagatgcactcgctgtgattttaagacaagctgtataaacagaactccactgcaagagggggggccgggccaggagaatctccgcttgtccaagacaggggcctaaggagggtctccacactgctgctaggggctgttgcatttttttattagtagaaagtggaaaggcctcttctcaacttttttcccttgggctggagaatttagaatcagaagtttcctggagttttcaggctatcatatatactgtatcctgaaaggcaacataattcttccttccctccttttaaaattttgtgttcctttttgcagcaattactcactaaagggcttcattttagtccagatttttagtctggctgcacctaacttatgcctcgcttatttagcccgagatctggtctttttttttttttttttttttttttttccgtctccccaaagctttatctgtcttgactttttaaaaaagtttgggggcagattctgaattggctaaaagacatgcatttttaaaactagcaactcttatttctttcctttaaaaatacatagcattaaatcccaaatcctatttaaagacctgacagcttgagaaggtcactactgcatttataggaccttctggtggttctgctgttacgtttgaagtctgacaatccttgagaatctttgcatgcagaggaggtaagaggtattggattttcacagaggaagaacacagcgcagaatgaagggccaggcttactgagctgtccagtggagggctcatgggtgggacatggaaaagaaggcagcctaggccctggggagcccagtccactgagcaagcaagggactgagtgagccttttgcaggaaaaggctaagaaaaaggaaaaccattctaaaacacaacaagaaactgtccaaatgctttgggaactgtgtttattgcctataatgggtccccaaaatgggtaacctagacttcagagagaatgagcagagagcaaaggagaaatctggctgtccttccattttcattctgttatctcaggtgagctggtagaggggagacattagaaaaaaatgaaacaacaaaacaattactaatgaggtacgctgaggcctgggagtctcttgactccactacttaattccgtttagtgagaaacctttcaattttcttttattagaagggccagcttactgttggtggcaaaattgccaacataagttaatagaaagttggccaatttcaccccattttctgtggtttgggctccacattgcaatgttcaatgccacgtgctgctgacaccgaccggagtactagccagcacaaaaggcagggtagcctgaattgctttctgctctttacatttcttttaaaataagcatttagtgctcagtccctactgagtactctttctctcccctcctctgaatttaattctttcaacttgcaatttgcaaggattacacatttcactgtgatgtatattgtgttgcaaaaaaaaaaaaaaagtgtctttgtttaaaattacttggtttgtgaatccatcttgctttttccccattggaactagtcattaacccatctctgaactggtagaaaaacatctgaagagctagtctatcagcatctgacaggtgaattggatggttctcagaaccatttcacccagacagcctgtttctatcctgtttaataaattagtttgggttctctacatgcataacaaaccctgctccaatctgtcacataaaagtctgtgacttgaagtttagtcagcacccccaccaaactttatttttctatgtgttttttgcaacatatgagtgttttgaaaataaagtacccatgtctttattagattta

SEQ ID NO: 159605 - DNA, 713 bp, Homo sapiens
  Payload ID: 11239
  Gene Symbol: NKX3-1
  Gene Name: NK3 homeobox 1
  Uniprot ID: Q99801
  ENST ID: ENST00000523261
  CDS Start-End: 1-480
atgctcagggttccggagccgcggcccggggaggccgagacgctggcagagaccgagccagaaaggcacttggggtcttatctgttggactctgaaaacacttcaggcgcccttccaaggcttccccaaacccctaagcagccgcagaagcgctcccgagctgccttctcccacactcaggtgatcgagttggagaggaagttcagccatcagaagtacctgtcggcccctgaacgggcccacctggccaagaacctcaagctcacggagacccaagtgaagatatggttccagaacagacgctataagactaagcgaaagcagctctcctcggagctgggagacttggagaagcactcctctttgccggccctgaaagaggaggccttctcccgggcctccctggtctccgtgtataacagctatccttactacccatacctgtactgcgtgggcagctggagcccagctttttggtaatgccagctcaggtgacaaccattatgatcaaaaactgccttccccagggtgtctctatgaaaagcacaaggggccaaggtcagggagcaagaggtgtgcacaccaaagctattggagatttgcgtggaaatctcagattcttcactggtgagacaatgaaacaacagagacagtgaaagttttaatacctaagtcattcctccagtgcatactgtaggtcattttttttgctt

SEQ ID NO: 159606 - DNA, 2801 bp, Homo sapiens
  Payload ID: 11240
  Gene Symbol: NKX3-2
  Gene Name: NK3 homeobox 2
  Uniprot ID: P78367
  ENST ID: ENST00000382438
  CDS Start-End: 637-1638
cgggaggggggtggtacagtggaacgcaagggaaggaaagagaaaagaaacagataaaaccagggcagggggtaaaaaagttccccgcgcctctcggaatccagcggccgcggccgcggctaccgccgccgccgccgggggtgggctccggaagagcctgcccagcagggaaggggaggacgggccaggagcgaaatcctgcaggcgaggaagggacagacgcgcaaagaaaaagtgactcgggctgtgcgccccggcggcgctcgggaggggactgctgccacggaggggcccccgccaatcctccttcacgtcccccgagggggcagaccccagcccgcccctaagggcgagaagcgatgagataatccagctgagctgcgaaaggagagcgtctggctctggattcggggggagggggtctccgggcggggtgggcctctaaggtgggggcgagggtcggcgctgatcctgggacggagtggggcgggagctgctgggccgcgcagcagtgggcggcggcggcctcgcacacccagctcactcgcgctgcggccgccggcgctctctgtcccgctcggagctgctcggcgccccagctgcccgccccgccggccgctcctgcccgcggcgcagatggctgtgcgcggcgccaacaccttgacgtccttctccatccaggcgatcctcaacaagaaagaggagcgcggcgggctggccgcgccagaggggcgcccggcgcccgggggcacagcggcatcggtggccgcggctcccgctgtctgctgttggcggctctttggggagagggacgcgggcgcgttggggggcgccgaggactctctgctggcgtctcctgccggtaccagaacagctgcggggcggactgcggagagcccggaaggctgggactcggactccgcgctcagcgaggagaacgagagcaggcggcgctgcgcggacgcgcggggggccagcggggccggccttgcggggggatccttgagcctcggccagccggtctgtgagctggccgcttccaaagacctagaggaggaagccgcgggccggagcgacagcgagatgtccgccagcgtctcaggcgaccgcagcccaaggaccgaggacgacggtgttggccccagaggtgcacacgtgtccgcgctgtgcagcggggccggcggcgggggcggcagcgggccggcaggcgtcgcggaggaggaggaggagccggcggcgcccaagccacgcaagaagcgctcgcgggccgctttctcccacgcgcaggtcttcgagctggagcgccgctttaaccaccagcgctacctgtccgggcccgagcgcgcagacctggccgcgtcgctgaagctcaccgagacgcaggtgaaaatctggttccagaaccgtcgctacaagacaaagcgccggcagatggcagccgacctgctggcctcggcgcccgccgccaagaaggtggccgtaaaggtgctggtgcgcgacgaccagagacaatacctgcccggcgaagtgctgcggccaccctcgcttctgccactgcagccctcctactattacccgtactactgcctcccaggctgggcgctctccacctgcgcagctgccgcaggcacccagtgaacccgcttgggctgaggcagcgagtgattcccgcgctccggctccggaccggcgctgacagctgtaggctgtagcctgcacggggcgccccgccaaggaggcacctggaggtgaaacccagctccagctcccgttagccaggacttgtcccctggcagctgggctgagtctgccctgagggggcgcctttttctaatttgaacagaggcaccctatggcctaggggccctgatcgcccacctgcctggaagcccctgggctctatttattatcatgacaatgttggaattaaattttgattcgaatatgtctgcctgggggtggggttttccctgagcggcaactcctggagaccacatagcctgaatcctcagaatttcaggcctgctgggagctttctgcactaggccacactagttcatggtatccatgctaccaatctatgtgtatctacatatcttttatttttggaaattgcatttgtaaccaaggggtgcgaaaccctggcagtcccaggcagcaccaggccaggggttgatttgaaacgtgaaggattgggttttcaggccctctgctccacccctcctgtgtgtcagagctagggtgggggtgcccgattcgggtgctgaatgtaaggaggggagcctccaagtgtggtgcaagccgggggtctccacatcttccttctctgaagtccaggtacctgcacaagcaggaagcgcctgggagtcccggaaggaggagagcgcacacccaggcagccctctgcggaaactttccttggtttctttttatttgtgtaaaggaggttaagacgtgtcgcacttttcagttgtttgtattcaaatgacgattatttttctactcaatgtgaatatccctggccagcctttccacggcgcccaccgcagtgccgctgcctggccctcagtgtctaccttctgccctctgcgactccagtgctctggcccgggactcccctatccgcccctcacttacccttaaacaggtgatcccacctgtcttgtcaacctcgccgcttttcgcctccttaatggcactgtgcactcaactagagtattaactgtaaaaagatttgtgaagtttggaagctctattcgctgtattttttctttaatttataaacttttagtttaacatgc

SEQ ID NO: 159607 - DNA, 2628 bp, Homo sapiens
  Payload ID: 11241
  Gene Symbol: NKX6-1
  Gene Name: NK6 homeobox 1
  Uniprot ID: P78426
  ENST ID: ENST00000295886
  CDS Start-End: 223-1326
ggcgagctgccgcctcccgcgtggagggtttggacatctctgctgcgcagctaggcgagcaactcccggcagcggcatttttggttcagttggcagctcgcctccgggcgcgccgagtgcctctccgctcgcgccctcggcgcttccggctcctctgagccccgcggggggcaccagccagcgccctcgctgcaaggctacggtctccggcgtggccgtgggatgttagcggtgggggcaatggagggcacccggcagagcgcattcctgctcagcagccctcccctggccgccctgcacagcatggccgagatgaagaccccgctgtaccctgccgcgtatcccccgctgcctgccggccccccctcctcctcgtcctcgtcgtcgtcctcctcgtcgccctccccgcctctgggcacccacaacccaggcggcctgaagcccccggccacgggggggctctcatccctcggcagccccccgcagcagctctcggccgccaccccacacggcatcaacgatatcctgagccggccctccatgcccgtggcctcgggggccgccctgccctccgcctcgccctccggttcctcctcctcctcttcctcgtccgcctctgcctcctccgcctctgccgccgccgcggctgctgccgcggccgcagccgccgcctcatccccggcggggctgctggccggactgccacgctttagcagcctgagcccgccgccgccgccgcccgggctctacttcagccccagcgccgcggccgtggccgccgtgggccggtaccccaagccgctggctgagctgcctggccggacgcccatcttctggcccggagtgatgcagagcccgccctggagggacgcacgcctggcctgtacccctcatcaaggatccattttgttggacaaagacgggaagagaaaacacacgagacccactttttccggacagcagatcttcgccctggagaagactttcgaacaaacaaaatacttggcggggcccgagagggctcgtttggcctattcgttggggatgacagagagtcaggtcaaggtctggttccagaaccgccggaccaagtggaggaagaagcacgctgccgagatggccacggccaagaagaagcaggactcggagacagagcgcctcaagggggcctcggagaacgaggaagaggacgacgactacaataagcctctggatcccaactcggacgacgagaaaatcacgcagctgttgaagaagcacaagtccagcagcggcggcggcggcggcctcctactgcacgcgtccgagccggagagctcatcctgaacgccgccgcccgccgcaccttcccggctccggcctccacctctggggccgcgaggggcgcggggaccgcgtgcacgccgcgcctgcccgctcctcggggcccggaggacccggccctgcctgcggggaccctttgctatttttgagatgtacatatctatttttttaaccttgaagttgtgggaggggatgtaggggagagagactccggggttgataaggcaagaaagaccaccaaatgcactgcgtaaatgtcgctactgaaacccgcagccgggccacggtcccagccgcgtccccataggcgggcagcggcctcagcgcccgggtccccctcgcccccagattttgcccccgcgggcggcggggtagggggcgccgagaggtgctgtggaagggttcacgctcaccgcatgggggacctcggagcgaagcgggcgggcgctgccacagatgggaagagggacgtttccccccccacacactgctgtgcaactaaagtaacctgttgaaggctctttgtaaataaatcgtgagttacactgactagaagttactttattgtgaatatttaaaatgtaaaatgcttttttgaatttcgtataaaaagatggactttcttccttctcctcctcccctttgaagagcgactcaagccacaccttcccttttattttgaacttaatttgagaagcgtagaatagaatgtccccaccttctccgtcccctcctctcgttcctctttcccgtttggatttgcagaatctcacctttgcccttcatctcttctcgccctgccctgccctgcccaccccctggatctacactgcgctcccgccccccggacttgaagtggaagacgtgggaaccagggagggcctctcacctgcctccctgttcctctctgaaattgcacagtcgtttgttgctatttattagtgatttaaagaaaatattggggagggaggggctacaatagcttgtatttaactcctttctgataaaaatgcgtgttaaagtaggtggtgggaattgttacaaccgctctgggtctgaaacataaaaattcatttagttactgtaattgaatttgaagtgttttgtatcataagaatactatagaatatgtaaattgttttctttttacagctaataatggtgatatattagcatctttaacctttattaatttatataaggaattcggtttgtaaagagaagaaaaccccctttgcaagaccagttaaatgtaatgcactttctgtttcaaaggataaatcaaattaaaaaaaacagtttgaa

SEQ ID NO: 159608 - DNA, 2194 bp, Homo sapiens
  Payload ID: 11241
  Gene Symbol: NKX6-1
  Gene Name: NK6 homeobox 1
  ENST ID: ENST00000515820
  CDS Start-End: 611-892
cattgaagacagtccagcgtccccagggcagggcgagcgcttccagccgctcaccagcgctgggcccgcgctttcccacctgcctccactctgggggctggcacacgctgcgtccgggcacatttggggacatcgtggagctcaacaccctaacacaagagcgagccaggagaagagtgagatgaagggacacggcctggggaaaatgtaccatcccgcaaagaccttgcttgaggcaaactgagttgccccaagatcacgctagtcttcggggtagtaggccgcagcgccgcggaggctcccagccttccaggtggacttcagggcccagcctggggtccttttctcgctcagttcttcgcctttcagcgagtctccgaagtttcttccaagtctccggacctccttagtgcggctgagcggcagtaactgcgggaagttgcgaaagccaagtggagatcaaggatccattttgttggacaaagacgggaagagaaaacacacgagacccactttttccggacagcagatcttcgccctggagaagactttcgaacaaacaaaatacttggcggggcccgagagggctcgtttggcctattcgttggggatgacagagagtcaggtcaaggtctggttccagaaccgccggaccaagtggaggaagaagcacgctgccgagatggccacggccaagaagaagcaggactcggagacagagcgcctcaagggggcctcggagaacgaggaagaggacgacgactacaataagcctctggatcccaactcggacgacgagaaaatcacgcagctgttgaagaagcacaagtccagcagcggcggcggcggcggcctcctactgcacgcgtccgagccggagagctcatcctgaacgccgccgcccgccgcaccttcccggctccggcctccacctctggggccgcgaggggcgcggggaccgcgtgcacgccgcgcctgcccgctcctcggggcccggaggacccggccctgcctgcggggaccctttgctatttttgagatgtacatatctatttttttaaccttgaagttgtgggaggggatgtaggggagagagactccggggttgataaggcaagaaagaccaccaaatgcactgcgtaaatgtcgctactgaaacccgcagccgggccacggtcccagccgcgtccccataggcgggcagcggcctcagcgcccgggtccccctcgcccccagattttgcccccgcgggcggcggggtagggggcgccgagaggtgctgtggaagggttcacgctcaccgcatgggggacctcggagcgaagcgggcgggcgctgccacagatgggaagagggacgtttccccccccacacactgctgtgcaactaaagtaacctgttgaaggctctttgtaaataaatcgtgagttacactgactagaagttactttattgtgaatatttaaaatgtaaaatgcttttttgaatttcgtataaaaagatggactttcttccttctcctcctcccctttgaagagcgactcaagccacaccttcccttttattttgaacttaatttgagaagcgtagaatagaatgtccccaccttctccgtcccctcctctcgttcctctttcccgtttggatttgcagaatctcacctttgcccttcatctcttctcgccctgccctgccctgcccaccccctggatctacactgcgctcccgccccccggacttgaagtggaagacgtgggaaccagggagggcctctcacctgcctccctgttcctctctgaaattgcacagtcgtttgttgctatttattagtgatttaaagaaaatattggggagggaggggctacaatagcttgtatttaactcctttctgataaaaatgcgtgttaaagtaggtggtgggaattgttacaaccgctctgggtctgaaacataaaaattcatttagttactgtaattgaatttgaagtgttttgtatcataagaatactatagaatatgtaaattgttttctttttacagctaataatggtgatatattagcatctttaacctttattaatttatataaggaattcggtttgtaaagagaagaaaaccccctttgcaagaccagttaaatgtaatgcactttctgtttcaaaggataaatcaaattaaaaaaaacagtttgaa

SEQ ID NO: 159609 - DNA, 2673 bp, Homo sapiens
  Payload ID: 11242
  Gene Symbol: NKX6-2
  Gene Name: NK6 homeobox 2
  Uniprot ID: Q9C056
  ENST ID: ENST00000368592
  CDS Start-End: 105-938
gcagccgacgcccgcccgggccgcgcgcaaacttcccgggccggcgggcaggggcggcggcggcggggcccggatgggagcccgggccggcggcggcggcgcccatggacactaaccgcccgggcgcgttcgtgctgagcagtgccccgctggccgcgctgcacaacatggccgagatgaagacgtcgctgttcccctacgcgctgcagggtccggccggcttcaaggcgcccgcgctggggggcctgggcgcgcagctcccgctcgggaccccgcacggcatcagcgacatcctgggccggcccgtgggcgcggcgggcgggggcctcctgggggggctgccccggctcaacgggctcgcgtcgtccgccggcgtttacttcgggcccgcggccgctgtggcgcgcggctaccccaagcccctggccgagctgccggggcgcccgcccatcttctggcccggcgtggtgcagggcgcgccctggagggacccgcgtctggctggcccggccccggccggcggcgtcctggacaaggacgggaagaagaagcactcgcgcccgaccttctcgggccagcagatcttcgcgctggagaaaaccttcgagcagaccaagtacctggcgggcccggagcgcgcgcgtctcgcctactcgctgggcatgaccgagagccaggtgaaggtctggttccagaaccgccggaccaagtggcgcaagcggcacgcggtggagatggcgtcggccaagaagaagcaggactcggacgccgagaagctgaaggtgggcggctcggacgcggaggacgacgacgaatacaaccggcccctggaccccaactcggacgacgagaagatcacgcggctgctcaagaagcacaaaccctcgaacttggcgctggtcagcccgtgcggcggcggcgcgggggacgccttgtgaggacccgcggggtgggggcgaatctatttttgcagaatccgggggcggccccgggtgggcgcgagtcgctttgtatcatcaataaattatttaacgggtccccgtcggagccgtcgctccggagcctgcgccgcgtgtttcttccgtctcgaacccggagcgaggcggcccctccccggccccggcttcgcccctgcgcccgcctcgggtcctccgggttcccggtgcggaggctgcgggccccgggcaggcgcgaggaggcggcgaaggcgcagggaaggggcccggcccgcgggaaggaaccgcagcgacagccgccaggagcccgggacggagccggggacggagcagcaggtacggcccggcccgcctcgcctcggggcggattcggacgcgcttgggggttcccgaaagggcgggtgagccgcgtacccgcctcgagtccccgcgggaggtttttcttcttccgttttcccgctttggggccacgtactcgttgccaccgggcacccgttcccgcttggccgagggcttcgctctgattatttccaaagtccctctgcgcatcagcggatcccataggcccgccctgggctcagccggtggaaccgggtctgatccgctgcacggaggcccttcggtcaccatcccgccagatcttcccgcggtggaaagcagtttcttccgaactaggaccgcaaagagaaatccgaaataattccgcccgcggagcggcggggcctcccgtgggtcacgcggggtcagggagccggaggccccctgggcaaggcccgcagcgcccagccgggggctcgggggacccgtctcctgccctgaaatgccgccagctccgcggggctgtgactgcggctgacaaaacccctccagcctcccgcagcctctgtggccggggctgcccatcgctgcatcttaatgggcgtggctgttgagttttaatttttaaaaattaaatgtaaataatgatatcactgcggtggtacgatttctcttggcatttgcggaagcgttaaagggaaatagaaagggcttaaactcggcgcgttttgttttaggctcttagcagccttctttacaaggaagcaactcgaagggcagaagcaacgcttttctgtggggagcccctctcagctcagagcagaggggcttcttaaagttttgaggaaggcaaagcgttgatataatcccgttttaaaatgttgagggataaatcctttattacagtagaaagtccaaaaggctgtgtttctcctctcaatgaacggcttagtgttttgtgacagcgtgtgatacagtgaaattccaggatttctaatgagcttgatctcaaataacaggctatacaggaggccgctcccctgagttagcatttcaaaggtggcaggagaagggaaaggaagaaaaagcaacacgggactattttcaccacggtcaattttattgcttaggaaccagaccggtcacttccaaaggcccctcagaacgaccaacagctgaaacccgcggggcggactccgtgttgaaccgcggacagcggcaaccacagcagcgacacggacctgtgcttccaccaagaacagattccgcagcggacagcagtcacttgcagtggtagtatttatcccacacaaacacccagctaatgccttcacccggtccaggaactctgtagtgttctaaagtaaaatcaataaaacatacatttgtgtttcatcaa

SEQ ID NO: 159610 - DNA, 1352 bp, Homo sapiens
  Payload ID: 11243
  Gene Symbol: NKX6-3
  Gene Name: NK6 homeobox 3
  Uniprot ID: A6NJ46
  ENST ID: ENST00000518699
  CDS Start-End: 178-975
gcagctgatcgggtgccggttcctgggccagggcctggcccatgccttaggtgggaggcagtcaggagctcggagacggtcctaagcctccaggcctgccatgagatttggggctagagagtgggctcttgggttttaggggcctggagaagccttccctgtcctgactgggagatcatggagtccaacctgcaggggacgttcctgctgaacaacacgccgctggctcagtttccggagatgaaggccccggtgtgccagtactctgtgcagaactccttctacaagctcagccccccagggctgggcccccagctggccgccggaaccccccacgggatcacggacatcctgagcaggcccgtggctgcgccgaacaacagcctcctctccggctacccccacgtggcaggctttggggggctcagctcgcagggggtctactacagcccccaggtagggaatttttccaaggctgggaacgagtacccgacccggacccggaactgctgggcggacacgggccaagactggcgaggcgggcggcagtgcagcaacaccccagaccccctgagtgacagcatacacaagaagaagcacacccggcccaccttcacggggcaccagatctttgccctggagaaaacctttgagcagaccaagtacttggctggccccgagagggcacggctggcatactcactgggcatgaccgagtcgcaggtcaaggtgtggttccagaaccgcaggaccaagtggcggaagaagagcgccctggagccctcgtcctccacgccccgggccccgggcggcgcgggtgcaggcgcaggcggggaccgcgcaccctcggagaacgaggacgacgagtacaacaagccgctggaccccgactcggacgacgagaagatccgcctgctgctgcgcaagcaccgcgccgccttctcggtgctcagcctgggagcgcacagcgtctgacgcccgccgtccaggcccgggatcctggctgcagcctgcggggggacgccgaggagcctaccttcccctccccttccccacgctcctgggggcgcagggactgagtctttctttggatgaggggcgcgtggaggaggagcagcaggtgcaggggaggaggaggggaggcgggggaggaggaggaaaaggagggaaaggggacaggcatcctagctaagggaggaggaggccaggagggaggcacagcactcctgagacctggaagccgctgccccttgcacctcctcgggcctcgcctgccagttctgcagattcacaagtggacagaggactaaaatgaccaggctctgcagccaagaaactggctgtggggtccc

SEQ ID NO: 159611 - DNA, 1683 bp, Homo sapiens
  Payload ID: 11243
  Gene Symbol: NKX6-3
  Gene Name: NK6 homeobox 3
  Uniprot ID: A6NJ46
  ENST ID: ENST00000524115
  CDS Start-End: 5-412
aaggatgcagcaggggcagctggcacctgggtctaggctttgctcagggccctggggcctccccgagctccaacccgctgcgccctcctcatcagccgctcagctgccctggggcgagagctggggggaagaagcagacactcctgcatgtctttctgcttctggggtgtggttccagaaccgcaggaccaagtggcggaagaagagcgccctggagccctcgtcctccacgccccgggccccgggcggcgcgggtgcaggcgcaggcggggaccgcgcaccctcggagaacgaggacgacgagtacaacaagccgctggaccccgactcggacgacgagaagatccgcctgctgctgcgcaagcaccgcgccgccttctcggtgctcagcctgggagcgcacagcgtctgacgcccgccgtccaggcccgggatcctggctgcagcctgcggggggacgccgaggagcctaccttcccctccccttccccacgctcctgggggcgcagggactgagtctttctttggatgaggggcgcgtggaggaggagcagcaggtgcaggggaggaggaggggaggcgggggaggaggaggaaaaggagggaaaggggacaggcatcctagctaagggaggaggaggccaggagggaggcacagcactcctgagacctggaagccgctgccccttgcacctcctcgggcctcgcctgccagttctgcagattcacaagtggacagaggactaaaatgaccaggctctgcagccaagaaactggctgtggggtcccagacatgccactgtgatccagctgttggggcggggggagtgggcaggacttcccagggagggaggcagctggctggggagtcagaagtccagagtcttgggccccaagccagctgctggctgcagaagaaaagacaggtgagtggccaggtgcactcctcagacctgtgcacaggaagggtcccactggaggggccagagctgagcacctaacccaggctgcaggaaatctgcctccaggaggggaagtgggacatcccagtggagaaaaaatgcccctgacactgcaggatgacggcccctgagctgcggaaatccccctggcctcctttctccgatttaccctcagggtcaatacctctgagaccgctgtgccctcctcatcctgacagccggggaaaaggggagggtgcagggagaggggaggcggggacggtgtgcccaagggccacccacctgggcatcatttggtgctgatataaggacaggcccacccagagagaaaaagcatcccacctggggaggaaaggaagggctgggaaagaccccagaacggcacccctccaacaaggcaggaagggagaaggacagcccctccggctgggtggaggatgccaggaaggggctgaaccacggcctgctgggaatcacggcccttcctttcctcagatcgccttgcggcctggcactggagctggtgctgacagggacgctggccaacagggtggtatttttcacccgggtgatctgagctgctggcaggtagggggtgggctgggggaggcgggtgagggctggtcttagataggaatgcagcccagaagggaccaagcacttgcccatcctcactggctttcaaaaaataaacagtaaaaataaaagtcccatgaacctt

SEQ ID NO: 159612 - DNA, 3744 bp, Homo sapiens
  Payload ID: 11244
  Gene Symbol: NLRX1
  Gene Name: NLR family member X1
  Uniprot ID: Q86UT6
  ENST ID: ENST00000292199
  CDS Start-End: 242-3169
cccgcggggatggaggcagggaggggggacgatggcgggacgggtggcgccggggttccagccctgcgcctgctccggagcaccgggcccctctcgctgaccccctcgtcccaggaccccgcaggcccgagtgcctgggctcgtcctctttcgcgcccgctgccaggtgccagggccgcgcaggcgggcggaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctacc

SEQ ID NO: 159613 - DNA, 3716 bp, Homo sapiens
  Payload ID: 11244
  Gene Symbol: NLRX1
  Gene Name: NLR family member X1
  Uniprot ID: Q86UT6
  ENST ID: ENST00000409991
  CDS Start-End: 216-3143
gcccgcggggatggaggcagggaggggggacgatggcgggacgggtggcgccggggttccagccctgcgcctgctccggagcaccgggcccctctcgctgaccccctcgtcccaggaccccgcaggcccgagtgcctgggctcgtcctctttcgcgcccgctgccaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttcta

SEQ ID NO: 159614 - DNA, 3665 bp, Homo sapiens
  Payload ID: 11244
  Gene Symbol: NLRX1
  Gene Name: NLR family member X1
  Uniprot ID: Q86UT6
  ENST ID: ENST00000409265
  CDS Start-End: 163-3090
cttctttcttaaccaaggttaccagcagccacacacataggtctgggctctgaagaggaccggatacataaggcagaacccaaggaagccttaggctcaggtctctgcctgaaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctacc

SEQ ID NO: 159615 - DNA, 4092 bp, Homo sapiens
  Payload ID: 11244
  Gene Symbol: NLRX1
  Gene Name: NLR family member X1
  Uniprot ID: Q86UT6
  ENST ID: ENST00000409109
  CDS Start-End: 588-3515
cgggacgggtggcgccggggttccagccctgcgcctgctccggagcaccgggcccctctcgctgaccccctcgtcccaggaccccgcaggcccgagtgcctgggctcgtcctctttcgcgcccgctgccaggtgccagggccgcgcaggcgggcggaggtgggcaggaagcgccacgccgaggagccggggactctgggagctagcgggagacgccggcgtccgcccagccgacccctctgggccgcggccgacggctcccggaactgggcagccgcgggtaaaggcctagcgggcttgataacccctgcgccctggctgggaggccgcgctgagcggggggcagggcgggccgggggaggaggctgtgcaagggccgcggggagatcccggccgagaacgagagggacggagctgggcgctgaatggcgggcgttctggcaagtctccccctgcgttcccgaggccacccgaaagtaggagagctgtttgggacccagtttggtggaggagctctggacctgtaggaacaccgcccctgacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaccaa

SEQ ID NO: 159616 - DNA, 762 bp, Homo sapiens
  Payload ID: 11244
  Gene Symbol: NLRX1
  Gene Name: NLR family member X1
  ENST ID: ENST00000454811
  CDS Start-End: 309-762
gtgagcccagggtgtggaagtgtgtggaagtgtagggataagggtgggggctttgggaactgggaagccccagggctaggccatgaatgggtgtcagacccgaagagcaggttggggtgcaagttgtccttcagcccccattcttccttctttcttaaccaaggttaccagcagccacacacataggtctgggctctgaagaggaccggatacataaggcagaacccaaggaagccttaggctcaggtctctgcctgaaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacc

SEQ ID NO: 159617 - DNA, 544 bp, Homo sapiens
  Payload ID: 11244
  Gene Symbol: NLRX1
  Gene Name: NLR family member X1
  ENST ID: ENST00000422249
  CDS Start-End: 164-544
agaacccaaggaagccttaggctcaggtctctgcctgaaggtaggctggggaggcggagagggacagagggaagaatcccctggacaccgcgcctcagggaggcccaggggtaaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccaccc

SEQ ID NO: 159618 - DNA, 558 bp, Homo sapiens
  Payload ID: 11244
  Gene Symbol: NLRX1
  Gene Name: NLR family member X1
  ENST ID: ENST00000449394
  CDS Start-End: 146-558
ctttcttaaccaaggttaccagcagccacacacataggtctgggctctgaagaggaccggatacataaggcagaacccaaggaagccttaggctcaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccacccca

SEQ ID NO: 159619 - DNA, 2850 bp, Homo sapiens
  Payload ID: 11244
  Gene Symbol: NLRX1
  Gene Name: NLR family member X1
  Uniprot ID: Q86UT6
  ENST ID: ENST00000525863
  CDS Start-End: 49-2814
gacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacagggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaccaa

SEQ ID NO: 159620 - DNA, 5347 bp, Homo sapiens
  Payload ID: 11245
  Gene Symbol: NAIP
  Gene Name: NLR family, apoptosis inhibitory protein
  Uniprot ID: Q13075
  ENST ID: ENST00000503719
  CDS Start-End: 1-3726
atgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 159621 - DNA, 579 bp, Homo sapiens
  Payload ID: 11245
  Gene Symbol: NAIP
  Gene Name: NLR family, apoptosis inhibitory protein
  ENST ID: ENST00000514857
  CDS Start-End: 1-579
ttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgacggagtcttgctctgtcacccaggctggagtgcagtggtgggattttggctcactgcaacctctacctcccaggttcaagctgattctcctgcctcagcctcccgagtagctgggattacagccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctca

SEQ ID NO: 159622 - DNA, 4543 bp, Homo sapiens
  Payload ID: 11245
  Gene Symbol: NAIP
  Gene Name: NLR family, apoptosis inhibitory protein
  Uniprot ID: Q13075
  ENST ID: ENST00000523981
  CDS Start-End: 534-4259
tggcacagatctccagaaacccttgtaatttcctgagtgacaggggtgatagaaacatcttttattagaatacttggtcttggttcctgacacaagagcttctaagacctttggaatctccaagtgataagagtgtatgacagtgagctaactggtggctgggatcctttagacaacttcaggatgggggctatcccctgaaagactaaggcatgattagaggtctgggatttgcagccccacgcctcgacctccagagagggtaaaagggctggagattgattaaccaccagttgccagtgatttaaccaatcatgcctaagtgatggcacctccattaaaaaataaaccacaggtttggagagctttcggtttggttaaccccaaccacataccaagaaggcgatgcacctcaaactgcatgaagacaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagca

SEQ ID NO: 159623 - DNA, 6124 bp, Homo sapiens
  Payload ID: 11245
  Gene Symbol: NAIP
  Gene Name: NLR family, apoptosis inhibitory protein
  Uniprot ID: Q13075
  ENST ID: ENST00000517649
  CDS Start-End: 292-4503
acaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 159624 - DNA, 1078 bp, Homo sapiens
  Payload ID: 11245
  Gene Symbol: NAIP
  Gene Name: NLR family, apoptosis inhibitory protein
  ENST ID: ENST00000519014
  CDS Start-End: 76-672
cttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacagctgagttcatggaggctcagagactttaagaaacatgcctatgtttctaccgaaatgtcatggcaaggctaaaacgtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagag

SEQ ID NO: 159625 - DNA, 4153 bp, Homo sapiens
  Payload ID: 11245
  Gene Symbol: NAIP
  Gene Name: NLR family, apoptosis inhibitory protein
  ENST ID: ENST00000508426
  CDS Start-End: 56-4099
tccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgagga

SEQ ID NO: 159626 - DNA, 894 bp, Homo sapiens
  Payload ID: 11245
  Gene Symbol: NAIP
  Gene Name: NLR family, apoptosis inhibitory protein
  ENST ID: ENST00000447012
  CDS Start-End: 1-15
gctcagagactttaagaaacatgcctatgtttctaccgaaatgtcatggcaaggctaaaacgtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacattcacagcttgcatgcgtgtgtgtgtgtgtgtgtgtgtgtgtgtgtgtgtgtgtgtgtatgtttgcttgcactgcataaaaacaattgcaacatcaacagaaataaaaattaaaggaataa

SEQ ID NO: 159627 - DNA, 6088 bp, Homo sapiens
  Payload ID: 11245
  Gene Symbol: NAIP
  Gene Name: NLR family, apoptosis inhibitory protein
  Uniprot ID: Q13075
  ENST ID: ENST00000194097
  CDS Start-End: 256-4467
cttctggtgtgagactctgtaggtttcattactccttttgggtcctgattaaatcctgttgactcaagaccttagagcatttactggtaaagtctctgactgcgcgattttttttttgcattttagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcgtgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 159628 - DNA, 5347 bp, Homo sapiens
  Payload ID: 11245
  Gene Symbol: NAIP
  Gene Name: NLR family, apoptosis inhibitory protein
  ENST ID: ENST00000618877
  CDS Start-End: 1-3726
atgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 159629 - DNA, 4153 bp, Homo sapiens
  Payload ID: 11245
  Gene Symbol: NAIP
  Gene Name: NLR family, apoptosis inhibitory protein
  ENST ID: ENST00000615009
  CDS Start-End: 56-4099
tccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcatccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgagga

SEQ ID NO: 159630 - DNA, 579 bp, Homo sapiens; identical to SEQ ID NO: 159621
  Payload ID: 11245
  Gene Symbol: NAIP
  Gene Name: NLR family, apoptosis inhibitory protein
  ENST ID: ENST00000616067
  CDS Start-End: 1-579

SEQ ID NO: 159631 - DNA, 3726 bp, Homo sapiens
  Payload ID: 11245
  Gene Symbol: NAIP
  Gene Name: NLR family, apoptosis inhibitory protein
  ENST ID: ENST00000616766
  CDS Start-End: 1-3726
atgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataa

SEQ ID NO: 159632 - DNA, 4153 bp, Homo sapiens; identical to SEQ ID NO: 159629
  Payload ID: 11245
  Gene Symbol: NAIP
  Gene Name: NLR family, apoptosis inhibitory protein
  ENST ID: ENST00000610590
  CDS Start-End: 56-4099

SEQ ID NO: 159633 - DNA, 4013 bp, Homo sapiens
  Payload ID: 11245
  Gene Symbol: NAIP
  Gene Name: NLR family, apoptosis inhibitory protein
  Uniprot ID: Q13075
  ENST ID: ENST00000612328
  CDS Start-End: 534-4013
tggcacagatctccagaaacccttgtaatttcctgagtgacaggggtgatagaaacatcttttattagaatacttggtcttggttcctgacacaagagcttctaagacctttggaatctccaagtgataagagtgtatgacagtgagctaactggtggctgggatcctttagacaacttcaggatgggggctatcccctgaaagactaaggcatgattagaggtctgggatttgcagccccacgcctcgacctccagagagggtaaaagggctggcgattgattaaccaccaattgccagtgatttagccaatcatgcctaagtgatggcacctccattaaaaaataaaccacaggtttggagagctttcggtttggttaaccccaaccacataccaagaaggcgatgcacctcaaactgcatgaagacaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaac

SEQ ID NO: 159634 - DNA, 4318 bp, Homo sapiens
  Payload ID: 11245
  Gene Symbol: NAIP
  Gene Name: NLR family, apoptosis inhibitory protein
  Uniprot ID: Q13075
  ENST ID: ENST00000620988
  CDS Start-End: 56-4267
tccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcatccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattga

SEQ ID NO: 159635 - DNA, 6087 bp, Homo sapiens
  Payload ID: 11245
  Gene Symbol: NAIP
  Gene Name: NLR family, apoptosis inhibitory protein
  ENST ID: ENST00000619206
  CDS Start-End: 255-4466
cttctggtgtgagactctgtaggtttcattactccttttgggtcctgattaaatcctgttgactcaagaccttagagcatttactggtaaagtctctgactgcgcgatttttttttgcattttagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcatccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 159636 - DNA, 490 bp, Homo sapiens
  Payload ID: 11245
  Gene Symbol: NAIP
  Gene Name: NLR family, apoptosis inhibitory protein
  ENST ID: ENST00000613897
  CDS Start-End: 1-15
gctcagagactttaagaaacatgcctatgtttctaccgaaatgtcatggcaaggctaaaacgtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatga

SEQ ID NO: 159637 - DNA, 1078 bp, Homo sapiens
  Payload ID: 11245
  Gene Symbol: NAIP
  Gene Name: NLR family, apoptosis inhibitory protein
  ENST ID: ENST00000622005
  CDS Start-End: 76-672
cttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcatccttcaggaactggccattttatgtccaagggatatccccttgtgtgctctcagaggctggctttgtctttacagctgagttcatggaggctcagagactttaagaaacatgcctatgtttctaccgaaatgtcatggcaaggctaaaacgtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagag

SEQ ID NO: 159638 - DNA, 4013 bp, Homo sapiens; identical to SEQ ID NO: 159633
  Payload ID: 11245
  Gene Symbol: NAIP
  Gene Name: NLR family, apoptosis inhibitory protein
  ENST ID: ENST00000628482
  CDS Start-End: 534-4013

SEQ ID NO: 159639 - DNA, 6124 bp, Homo sapiens
  Payload ID: 11245
  Gene Symbol: NAIP
  Gene Name: NLR family, apoptosis inhibitory protein
  ENST ID: ENST00000625431
  CDS Start-End: 292-4503
acaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcatccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 159640 - DNA, 1078 bp, Homo sapiens; identical to SEQ ID NO: 159637
  Payload ID: 11245
  Gene Symbol: NAIP
  Gene Name: NLR family, apoptosis inhibitory protein
  ENST ID: ENST00000629198
  CDS Start-End: 76-672

SEQ ID NO: 159641 - DNA, 3414 bp, Homo sapiens
  Payload ID: 11246
  Gene Symbol: NLRC3
  Gene Name: NLR family, CARD domain containing 3
  ENST ID: ENST00000324659
  CDS Start-End: 76-3414
tgagaactcaggctggcacagggattcccagggcatctaccaccacgcagctggagcagggctgagcccaggagcatggagatggacgcccccaggccccccagtcttgctgtccctggagcagcatcgaggcccgggaggctgctggatggggggcacggcaggcagcaggttcaggccctctcttcacagctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccaggccccgcaggccctggataggacaccggatgccccgctggggccctgcagcaatgactcaaggatacagaggcaccgcaaggccctgctgagcaaggtgggaggtggcccggagctgggcggaccctggcacaggctggcctccctcctgctggtggagggcctgacggacctgcagctgagggaacacgacttcacacaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggctggacaccaaccagttccaggaccccgtgatggagctgctgggcagcgtgctgagtgggaaggactgtcgcattcagaagatcagcttggcggagaaccagatcagtaacaaaggggccaaagctctggccagatccctcttggtcaacagaagtctgacctctctggacctccgcggtaactccattggaccacaaggggccaaggcgctggcagacgctttgaagatcaaccgcaccctgacctccctgagcctccagggcaacaccgttagggatgatggtgccaggtccatggctgaggccttggcctccaaccggaccctctccatgctgcacctgcagaagaacagcatcgggcccatgggagcccagcggatggcagatgccttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgacagccaacctcctccacgaccagggtgcccgggccatcgcagtggcagtgagagaaaaccgcaccctcacctcccttcacctgcagtggaacttcatccaggccggcgctgcccaggccctgggacaagcactacagctcaacaggagcctcaccagcttagatttacaggagaacgccatcggggatgacggagcgtgtgcggtggcccgtgcactgaaggtcaacacagccctcactgctctctatctccaggtggcctcaattggtgcttcaggcgcccaggtgctaggggaagccttggctgtgaacagaaccttggagattctcgacttaagaggaaatgccattggggtggctggagccaaagccctggcaaatgctctgaaggtaaactcaagtctccggagactcaatcttcaagagaattctctggggatggacggggcgatatgcattgccacagcactgtctggaaaccacaggctccagcatatcaatctccagggaaaccacattggggactccggggccaggatgatctcagaggccatcaagacaaatgctcccacgtgcactgttgaaatgtga

SEQ ID NO: 159642 - DNA, 6401 bp, Homo sapiens
  Payload ID: 11246
  Gene Symbol: NLRC3
  Gene Name: NLR family, CARD domain containing 3
  Uniprot ID: Q7RTR2
  ENST ID: ENST00000359128
  CDS Start-End: 412-3609
acagccggtgggctcggtggggctgcagaaggtcggggctgcactgctctcggcccccacacggttggttggttggcgtggtaagtgccctgatccctggtcctgagaactcaggctggcacagggattcccagggcatctaccaccacgcagctggagcagggctgagcccaggagcatggagatggacgcccccaggccccccagtcttgctgtccctggagcagcatcgaggcccgggagaactgtggacaacggaaggctgagccccatccattgagttcctggggccccactggaggggctgctgtggccagggtgcacggtcacaaatgaagacaccaaggcgcagagaggtgactcagcctgccctcagtcacctatctgctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccaggccccgcaggccctggataggacaccggatgccccgctggggccctgcagcaatgactcaaggatacagaggcaccgcaaggccctgctgagcaaggtgggaggtggcccggagctgggcggaccctggcacaggctggcctccctcctgctggtggagggcctgacggacctgcagctgagggaacacgacttcacacaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggctggacaccaaccagttccaggaccccgtgatggagctgctgggcagcgtgctgagtgggaaggactgtcgcattcagaagatcagcttggcggagaaccagatcagtaacaaaggggccaaagctctggccagatccctcttggtcaacagaagtctgacctctctggacctccgcggtaactccattggaccacaaggggccaaggcgctggcagacgctttgaagatcaaccgcaccctgacctccctgagcctccagggcaacaccgttagggatgatggtgccaggtccatggctgaggccttggcctccaaccggaccctctccatgctgcacctgcagaagaacagcatcgggcccatgggagcccagcggatggcagatgccttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgacagccaacctcctccacgaccagggtgcccgggccatcgcagtggcagtgagagaaaaccgcaccctcacctcccttcacctgcagtggaacttcatccaggccggcgctgcccaggccctgggacaagcactacagctcaacaggagcctcaccagcttagatttacaggagaacgccatcggggatgacggagcgtgtgcggtggcccgtgcactgaaggtcaacacagccctcactgctctctatctccaggtggcctcaattggtgcttcaggcgcccaggtgctaggggaagccttggctgtgaacagaaccttggagattctcgacttaagaggaaatgccattggggtggctggagccaaagccctggcaaatgctctgaaggtaaactcaagtctccggagactcaatcttcaagagaattctctggggatggacggggcgatatgcattgccacagcactgtctggaaaccacaggctccagcatatcaatctccagggaaaccacattggggactccggggccaggatgatctcagaggccatcaagacaaatgctcccacgtgcactgttgaaatgtgatcctggtggacggatcaggagaatgggcagatgctcagctggaagcttttgaacagaaaggccgacttctggggggcctgtctgggagctgggaacgctgcttgctcagcacgagagccgggctctgcagggaggaaggagaggtgctgccggaggaggtcgtgagctcctcttctgctgcaggagtggtccaggcagggggtgacgggtactctgttatggcacagagaagggaggggccacccccaagggactaggggccaaaggcctgaaagctgagcagtacaggaggctggttccagctttacaccctgaggacttcatgtgtccccaacctttaaaaatgtttattactgcccctttccactcacctggttaaaaatcatcccatgctctgagatgagctgccacctcaagcccgtgaggagcatccgtttggtaggggtaacagaggggacccttctttatcttctcaagaagaagatttcagggtatcatccttacagacatgaaaaagctatgggaaaattgtgaagataaatgaaagttttaattctaggattctggaaacagagacagtaagagttctccaaggattttgccttttttgtttgtttttgagatggagtctcgctcttgtcgcccaggctggagtgcagtggcacgatctcagctccctgcaacctccgcctcccgggttcatgtgattctcctgcctcagcctccccagtagctgggaatacaggcacccgccaccatgcccggctaatttttgtagttttagtagagacggggtttcatcatgttggccaggctggtctcgaactcctgacctcaggtgatccatcagcctgggcctcccaaagtactgggattacaggcatgagccaccacacctggccccattttttatttattacaaaatcaaagacatgggtgatgcctggcacatgttgtctggagtctggcacactggttatcaatagcacattcagtgtattcagtgatgtcattctttatttatttttgagacagaatctgtcacccaggctggagtgcagtggcatgatctcagctcactgtaggctctacctcatgggttccagtgattctcctgcctcggcctcccaagtagttgggtctacaggcacgcaccaccacacccagctaatttttgtatttttagtagagatggggtttcaccatgttgatcaggctggtctttaactcctgacctcaagtgatccacccacctcagcctcccaaagtgctgggattacaggtgtgagccactgcacctggcagtgatgtcattccttactaggcttccaaagccactgctgtggccacagcttccatggagacaggcaagctgagcctctatgtggcaccaattcctgcagctgtttgtgttggagggaaaaaaatccaaatggacatcaacagctttcatcaactaaataaccacagaaaatatttatgaagactataaagcaatgattacttttgaattggaaaggaatcactattatttgaaatgtttcttcaaaagtgagcatccggacaggaaccatcatggatgctgaggccatggatgaaggcctactcgggaagatgatatccttgcagtctcaaaacggcaccccacaaaggtgatatcctaatttacaaagggaaaaaggtaccttaatctgaaatctggcaaatgcagcctcaacagaagtgacagaattgaacatcgccaataatgggacacacagacatcacatgcccccagtctgatgcaccacggagtcgtctctgatgtattcttgtcaaaaaatgtttgcctgattctaatcatgaaagaacaattagaaaaaatccaaattgacagatattctgcagaataaatggcctgacctcatcaaaaacatcaatgtcatgaaaaacacaaaacattgcagatagcgtgaaattaaagattacagagatataatttaatgcaagatctctgactggatcctagactgcaggaaaaagtctgctataaagaacatttggatcacttgtagtagctgggaaataaaacaaaacattatttgtaaaaggggggaaatctgaacatgggtcttgcagtatttatgacagtttttgcggggcagagatttctagattgacagctgttttagtactttcaaggtgatgctctgtctgctggtttgcattgtttctgtctgagttaagagactggcagaacacagagttgcagtagccaaacactggagaaagctgggccctacagaaacctaacgctgaagaaacctcaggagccaaactggtggagaaaacaaagagtcctccctctctcccttttcaaataatgatcatacatcttcaagctgtctgaaatggttaaggagttcagtctgtcgtcaggcacacaccagagccagctagcccacacagaccccatcagagcaaaacagacaagagaatttaattcatatccacatagaaaggacttctaggtaggaggtagaccctttagctcccttccaattaaaggagtccccaattctggcacctgagagtcccctgggtctaacagctatgatatttatgtagtgtgttgcttacctaaatgaatacaatttccttccagacacgtgacactgatattaaagtgctaatgagagggatctatttcttcttgtacgctaaaagagaaacagcagttcagatttcccatcagaagtccgaggactttgttcttgataactactaccaataaaaattgagtatttgaaaaa

SEQ ID NO: 159643 - DNA, 6041 bp, Homo sapiens
  Payload ID: 11246
  Gene Symbol: NLRC3
  Gene Name: NLR family, CARD domain containing 3
  Uniprot ID: Q7RTR2
  ENST ID: ENST00000448023
  CDS Start-End: 57-3254
gcaggcagcaggttcaggccctctcttcacagctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccaggccccgcaggccctggataggacaccggatgccccgctggggccctgcagcaatgactcaaggatacagaggcaccgcaaggccctgctgagcaaggtgggaggtggcccggagctgggcggaccctggcacaggctggcctccctcctgctggtggagggcctgacggacctgcagctgagggaacacgacttcacacaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggctggacaccaaccagttccaggaccccgtgatggagctgctgggcagcgtgctgagtgggaaggactgtcgcattcagaagatcagcttggcggagaaccagatcagtaacaaaggggccaaagctctggccagatccctcttggtcaacagaagtctgacctctctggacctccgcggtaactccattggaccacaaggggccaaggcgctggcagacgctttgaagatcaaccgcaccctgacctccctgagcctccagggcaacaccgttagggatgatggtgccaggtccatggctgaggccttggcctccaaccggaccctctccatgctgcacctgcagaagaacagcatcgggcccatgggagcccagcggatggcagatgccttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgacagccaacctcctccacgaccagggtgcccgggccatcgcagtggcagtgagagaaaaccgcaccctcacctcccttcacctgcagtggaacttcatccaggccggcgctgcccaggccctgggacaagcactacagctcaacaggagcctcaccagcttagatttacaggagaacgccatcggggatgacggagcgtgtgcggtggcccgtgcactgaaggtcaacacagccctcactgctctctatctccaggtggcctcaattggtgcttcaggcgcccaggtgctaggggaagccttggctgtgaacagaaccttggagattctcgacttaagaggaaatgccattggggtggctggagccaaagccctggcaaatgctctgaaggtaaactcaagtctccggagactcaatcttcaagagaattctctggggatggacggggcgatatgcattgccacagcactgtctggaaaccacaggctccagcatatcaatctccagggaaaccacattggggactccggggccaggatgatctcagaggccatcaagacaaatgctcccacgtgcactgttgaaatgtgatcctggtggacggatcaggagaatgggcagatgctcagctggaagcttttgaacagaaaggccgacttctggggggcctgtctgggagctgggaacgctgcttgctcagcacgagagccgggctctgcagggaggaaggagaggtgctgccggaggaggtcgtgagctcctcttctgctgcaggagtggtccaggcagggggtgacgggtactctgttatggcacagagaagggaggggccacccccaagggactaggggccaaaggcctgaaagctgagcagtacaggaggctggttccagctttacaccctgaggacttcatgtgtccccaacctttaaaaatgtttattactgcccctttccactcacctggttaaaaatcatcccatgctctgagatgagctgccacctcaagcccgtgaggagcatccgtttggtaggggtaacagaggggacccttctttatcttctcaagaagaagatttcagggtatcatccttacagacatgaaaaagctatgggaaaattgtgaagataaatgaaagttttaattctaggattctggaaacagagacagtaagagttctccaaggattttgccttttttgtttgtttttgagatggagtctcgctcttgtcgcccaggctggagtgcagtggcacgatctcagctccctgcaacctccgcctcccgggttcatgtgattctcctgcctcagcctccccagtagctgggaatacaggcacccgccaccatgcccggctaatttttgtagttttagtagagacggggtttcatcatgttggccaggctggtctcgaactcctgacctcaggtgatccatcagcctgggcctcccaaagtactgggattacaggcatgagccaccacacctggccccattttttatttattacaaaatcaaagacatgggtgatgcctggcacatgttgtctggagtctggcacactggttatcaatagcacattcagtgtattcagtgatgtcattctttatttatttttgagacagaatctgtcacccaggctggagtgcagtggcatgatctcagctcactgtaggctctacctcatgggttccagtgattctcctgcctcggcctcccaagtagttgggtctacaggcacgcaccaccacacccagctaatttttgtatttttagtagagatggggtttcaccatgttgatcaggctggtctttaactcctgacctcaagtgatccacccacctcagcctcccaaagtgctgggattacaggtgtgagccactgcacctggcagtgatgtcattccttactaggcttccaaagccactgctgtggccacagcttccatggagacaggcaagctgagcctctatgtggcaccaattcctgcagctgtttgtgttggagggaaaaaaatccaaatggacatcaacagctttcatcaactaaataaccacagaaaatatttatgaagactataaagcaatgattacttttgaattggaaaggaatcactattatttgaaatgtttcttcaaaagtgagcatccggacaggaaccatcatggatgctgaggccatggatgaaggcctactcgggaagatgatatccttgcagtctcaaaacggcaccccacaaaggtgatatcctaatttacaaagggaaaaaggtaccttaatctgaaatctggcaaatgcagcctcaacagaagtgacagaattgaacatcgccaataatgggacacacagacatcacatgcccccagtctgatgcaccacggagtcgtctctgatgtattcttgtcaaaaaatgtttgcctgattctaatcatgaaagaacaattagaaaaaatccaaattgacagatattctgcagaataaatggcctgacctcatcaaaaacatcaatgtcatgaaaaacacaaaacattgcagatagcgtgaaattaaagattacagagatataatttaatgcaagatctctgactggatcctagactgcaggaaaaagtctgctataaagaacatttggatcacttgtagtagctgggaaataaaacaaaacattatttgtaaaaggggggaaatctgaacatgggtcttgcagtatttatgacagtttttgcggggcagagatttctagattgacagctgttttagtactttcaaggtgatgctctgtctgctggtttgcattgtttctgtctgagttaagagactggcagaacacagagttgcagtagccaaacactggagaaagctgggccctacagaaacctaacgctgaagaaacctcaggagccaaactggtggagaaaacaaagagtcctccctctctcccttttcaaataatgatcatacatcttcaagctgtctgaaatggttaaggagttcagtctgtcgtcaggcacacaccagagccagctagcccacacagaccccatcagagcaaaacagacaagagaatttaattcatatccacatagaaaggacttctaggtaggaggtagaccctttagctcccttccaattaaaggagtccccaattctggcacctgagagtcccctgggtctaacagctatgatatttatgtagtgtgttgcttacctaaatgaatacaatttccttccagacacgtgacactgatattaaagtgctaatgagagggatctatttcttcttgtacgctaaaagagaaacagcagttcagatttcccatcagaagtccgaggactttgttcttgataactactaccaataaaaattgagtatttg

SEQ ID NO: 159644 - DNA, 588 bp, Homo sapiens
  Payload ID: 11246
  Gene Symbol: NLRC3
  Gene Name: NLR family, CARD domain containing 3
  ENST ID: ENST00000618137
  CDS Start-End: 1-588
cctccgcggtaactccattggaccacaaggggccaaggcgctggcagacgctttgaagatcaaccgcaccctgacctccctgagcctccagggcaacaccgttagggatgatggtgccaggtccatggctgaggccttggcctccaaccggaccctctccatgctgcacctgcagaagaacagcatcgggcccatgggagcccagcggatggcagatgccttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgcagtggaacttcatccaggccggcgctgcccaggccctgggacaagcactacagctcaacaggagcctcaccagcttaga

SEQ ID NO: 159645 - DNA, 6602 bp, Homo sapiens
  Payload ID: 11246
  Gene Symbol: NLRC3
  Gene Name: NLR family, CARD domain containing 3
  Uniprot ID: Q7RTR2
  ENST ID: ENST00000615877
  CDS Start-End: 482-2767
gccacagggacagccggtgggctcggtggggctgcagaaggtcggggctgcactgctctcggcccccacacggttggttggttggcgtggtaagtgccctgatccctggtcctgagaactcaggctggcacagggattcccagggcatctaccaccacgcagctggagcagggctgagcccaggagcatggagatggacgcccccaggccccccagtcttgctgtccctggagcagcatcgaggcccgggagggctgccatcagcagcagtgagccatcacctctgctggccacattgtgttttttctcctagaactgtggacaacggaaggctgagccccatccattgagttcctggggccccactggaggggctgctgtggccagggtgcacggtcacaaatgaagacaccaaggcgcagagaggtgactcagcctgccctcagtcacctatctgctcctggaggtgatccccgactccatgaggaagcaagaggtgcggacgggcagggaggccggccagggccacggtacgggctccccagccgagcaggtgaaagccctcatggatctgctggctgggaagggcagtcaaggctcccaggccccgcaggccctggataggacaccggatgccccgctggggccctgcagcaatgactcaaggatacagaggcaccgcaaggccctgctgagcaaggtgggaggtggcccggagctgggcggaccctggcacaggctggcctccctcctgctggtggagggcctgacggacctgcagctgagggaacacgacttcacacaggtggaggccacccgcgggggcgggcaccccgccaggaccgtcgccctggaccggctcttcctgcctctctcccgggtgtctgtcccaccccgggtctccatcactatcggggtggccggcatgggcaagaccaccctggtgaggcacttcgtccgcctctgggcccatgggcaggtcggcaaggacttctcgctggtgctgcctctgaccttccgggatctcaacacccacgagaagctgtgtgccgaccgactcatctgctcggtcttcccgcacgtcggggagcccagcctggcggtggcagtcccagccagggccctcctgatcctggacggcttggatgagtgcaggacgcctctggacttctccaacaccgtggcctgcacggacccaaagaaggagatcccggtggaccacctgatcaccaacatcatccgtggcaacctctttccggaagtttccatctggatcacctcccgtcccagtgcatctggccagatcccagggggcctggtggaccggatgacggagatccggggctttaacgaggaggagatcaaggtgtgtttggagcagatgttccccgaggaccaggcccttctgggctggatgctgagccaagtgcaggctgacagggccctgtacctgatgtgcaccgtcccagccttctgcaggctcacggggatggcgctaggccacctgtggcgcagcaggacggggccccaggatgcagagctgtggcccccgaggaccctgtgcgagctctactcatggtactttaggatggccctcagcggggaggggcaggagaagggcaaggcaagccctcgcatcgagcaggtggcccatggtggccgcaagatggtggggacattgggccgtctggccttccatgggctgctcaagaagaaatacgtgttttacgagcaagacatgaaggcgtttggtgtagacctcgctctgctgcagggcgccccgtgcagctgcttcctgcagagagaggagacgttggcatcgtcagtggcctactgcttcacccacctgtccctgcaggagtttgtggcagccgcgtattactatggcgcatccaggagggccatcttcgacctcttcactgagagcggcgtatcctggcccaggctgggcttcctcacgcatttcaggagcgcagcccagcgggccatgcaggcagaggacgggaggctggacgtgttcctgcgcttcctctccggcctcttgtctccgagggtcaatgccctcctggccggctccctgctggcccaaggcgagcaccaggcctaccggacccaggtggctgagctcctgcagggctgcctgcgccccgatgccgcagtctgtgcacgggccatcaacgtgttgcactgcctgcatgagctgcagcacaccgagctggcccgcagcgtggaggaggccatggagagcggggccctggccaggctgactggtcccgcgcaccgcgctgccctggcctacctcctgcaggtgtccgacgcctgtgcccaggaggccaacctgtccctgagcctcagccagggcgtccttcagagcctgctgccccagctgctctactgccggaagctcaggctggacaccaaccagttccaggaccccgtgatggagctgctgggcagcgtgctgagtgggaaggactgtcgcattcagaagatcagcttggcggagaaccagatcagtaacaaaggggccaaagctctggccagatccctcttggtcaacagaagtctgacctctctggacctccgcggtaactccattggaccacaaggggccaaggcgctggcagacgctttgaagatcaaccgcaccctgacctccctgagggtgaaattcatgtaccataaaattgactgttttaggcgggtcccagaggctgatgcctgtaatcccagcactttgggaggccaaggcaggtggatcacttgaggtcgggagttcgagaccagcctggccaacatgcctccagggcaacaccgttagggatgatggtgccaggtccatggctgaggccttggcctccaaccggaccctctccatgctgcacctgcagaagaacagcatcgggcccatgggagcccagcggatggcagatgccttgaagcagaacaggagtctgaaagagctcatgttctccagtaatagtattggtgatggaggtgccaaggccctggctgaggccctgaaggtgaaccagggcctggagagcctggacctgcagagcaattccatcagtgacgcaggagtggcagcactgatgggggccctctgcaccaaccagaccctcctcagcctcagccttcgagaaaactccatcagtcccgagggagcccaggccatcgctcatgccctctgcgccaacagcaccctgaagaacctggacctgacagccaacctcctccacgaccagggtgcccgggccatcgcagtggcagtgagagaaaaccgcaccctcacctcccttcacctgcagtggaacttcatccaggccggcgctgcccaggccctgggacaagcactacagctcaacaggagcctcaccagcttagatttacaggagaacgccatcggggatgacggagcgtgtgcggtggcccgtgcactgaaggtcaacacagccctcactgctctctatctccaggtggcctcaattggtgcttcaggcgcccaggtgctaggggaagccttggctgtgaacagaaccttggagattctcgacttaagaggaaatgccattggggtggctggagccaaagccctggcaaatgctctgaaggtaaactcaagtctccggagactcaatcttcaagagaattctctggggatggacggggcgatatgcattgccacagcactgtctggaaaccacaggctccagcatatcaatctccagggaaaccacattggggactccggggccaggatgatctcagaggccatcaagacaaatgctcccacgtgcactgttgaaatgtgatcctggtggacggatcaggagaatgggcagatgctcagctggaagcttttgaacagaaaggccgacttctggggggcctgtctgggagctgggaacgctgcttgctcagcacgagagccgggctctgcagggaggaaggagaggtgctgccggaggaggtcgtgagctcctcttctgctgcaggagtggtccaggcagggggtgacgggtactctgttatggcacagagaagggaggggccacccccaagggactaggggccaaaggcctgaaagctgagcagtacaggaggctggttccagctttacaccctgaggacttcatgtgtccccaacctttaaaaatgtttattactgcccctttccactcacctggttaaaaatcatcccatgctctgagatgagctgccacctcaagcccgtgaggagcatccgtttggtaggggtaacagaggggacccttctttatcttctcaagaagaagatttcagggtatcatccttacagacatgaaaaagctatgggaaaattgtgaagataaatgaaagttttaattctaggattctggaaacagagacagtaagagttctccaaggattttgccttttttgtttgtttttgagatggagtctcgctcttgtcgcccaggctggagtgcagtggcacgatctcagctccctgcaacctccgcctcccgggttcatgtgattctcctgcctcagcctccccagtagctgggaatacaggcacccgccaccatgcccggctaatttttgtagttttagtagagacggggtttcatcatgttggccaggctggtctcgaactcctgacctcaggtgatccatcagcctgggcctcccaaagtactgggattacaggcatgagccaccacacctggccccattttttatttattacaaaatcaaagacatgggtgatgcctggcacatgttgtctggagtctggcacactggttatcaatagcacattcagtgtattcagtgatgtcattctttatttatttttgagacagaatctgtcacccaggctggagtgcagtggcatgatctcagctcactgtaggctctacctcatgggttccagtgattctcctgcctcggcctcccaagtagttgggtctacaggcacgcaccaccacacccagctaatttttgtatttttagtagagatggggtttcaccatgttgatcaggctggtctttaactcctgacctcaagtgatccacccacctcagcctcccaaagtgctgggattacaggtgtgagccactgcacctggcagtgatgtcattccttactaggcttccaaagccactgctgtggccacagcttccatggagacaggcaagctgagcctctatgtggcaccaattcctgcagctgtttgtgttggagggaaaaaaatccaaatggacatcaacagctttcatcaactaaataaccacagaaaatatttatgaagactataaagcaatgattacttttgaattggaaaggaatcactattatttgaaatgtttcttcaaaagtgagcatccggacaggaaccatcatggatgctgaggccatggatgaaggcctactcgggaagatgatatccttgcagtctcaaaacggcaccccacaaaggtgatatcctaatttacaaagggaaaaaggtaccttaatctgaaatctggcaaatgcagcctcaacagaagtgacagaattgaacatcgccaataatgggacacacagacatcacatgcccccagtctgatgcaccacggagtcgtctctgatgtattcttgtcaaaaaatgtttgcctgattctaatcatgaaagaacaattagaaaaaatccaaattgacagatattctgcagaataaatggcctgacctcatcaaaaacatcaatgtcatgaaaaacacaaaacattgcagatagcgtgaaattaaagattacagagatataatttaatgcaagatctctgactggatcctagactgcaggaaaaagtctgctataaagaacatttggatcacttgtagtagctgggaaataaaacaaaacattatttgtaaaaggggggaaatctgaacatgggtcttgcagtatttatgacagtttttgcggggcagagatttctagattgacagctgttttagtactttcaaggtgatgctctgtctgctggtttgcattgtttctgtctgagttaagagactggcagaacacagagttgcagtagccaaacactggagaaagctgggccctacagaaacctaacgctgaagaaacctcaggagccaaactggtggagaaaacaaagagtcctccctctctcccttttcaaataatgatcatacatcttcaagctgtctgaaatggttaaggagttcagtctgtcgtcaggcacacaccagagccagctagcccacacagaccccatcagagcaaaacagacaagagaatttaattcatatccacatagaaaggacttctaggtaggaggtagaccctttagctcccttccaattaaaggagtccccaattctggcacctgagagtcccctgggtctaacagctatgatatttatgtagtgtgttgcttacctaaatgaatacaatttccttccagacacgtgacactgatattaaagtgctaatgagagggatctatttcttcttgtacgctaaaagagaaacagcagttcagatttcccatcagaagtccgaggactttgttcttgataactactaccaataaaaattgagtatttg

SEQ ID NO: 159646 - DNA, 1362 bp, Homo sapiens
  Payload ID: 11247
  Gene Symbol: NLRC4
  Gene Name: NLR family, CARD domain containing 4
  Uniprot ID: Q9NPP4
  ENST ID: ENST00000342905
  CDS Start-End: 265-1344
tgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagc

SEQ ID NO: 159647 - DNA, 3359 bp, Homo sapiens
  Payload ID: 11247
  Gene Symbol: NLRC4
  Gene Name: NLR family, CARD domain containing 4
  Uniprot ID: Q9NPP4
  ENST ID: ENST00000360906
  CDS Start-End: 265-3339
tgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgaattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagcca

SEQ ID NO: 159648 - DNA, 3581 bp, Homo sapiens
  Payload ID: 11247
  Gene Symbol: NLRC4
  Gene Name: NLR family, CARD domain containing 4
  Uniprot ID: Q9NPP4
  ENST ID: ENST00000404025
  CDS Start-End: 490-3564
agaatgtcatcctcaagggaagtgcagagagatttcttcagtcctcagctgagtataagctggcctcctggagtctgtgaacacaaacgtccaatgtgagtgtgcctgtgcaagcccctggctgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggagaactcgaggcctcactgaaacggaaagcaaatacaaagaaactttattttaaaaacatgtcttggtctcccaagaagagggcaattggattgctcagccagaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgaattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaag

SEQ ID NO: 159649 - DNA, 3355 bp, Homo sapiens
  Payload ID: 11247
  Gene Symbol: NLRC4
  Gene Name: NLR family, CARD domain containing 4
  Uniprot ID: Q9NPP4
  ENST ID: ENST00000402280
  CDS Start-End: 262-3336
acactgtcctctcacagaacaagaaggtatctggtctacaagaactcgaggcctcactgaaacggaaagcaaatacaaagaaactttattttaaaaacatgtcttggtctcccaagaagagggcaattggattgctcagccagaatgaagagtagttttacagaaaaaagaggacaatattgggatcacctttgacctttccatttggaaataatattttctattgtgttatagaaaggtgggaagctttcatccagaacaatgaatttcataaaggacaatagccgagcccttattcaaagaatgggaatgactgttataaagcaaatcacagatgacctatttgtatggaatgttctgaatcgcgaagaagtaaacatcatttgctgcgagaaggtggagcaggatgctgctagagggatcattcacatgattttgaaaaagggttcagagtcctgtaacctctttcttaaatcccttaaggagtggaactatcctctatttcaggacttgaatggacaaagtctttttcatcagacatcagaaggagacttggacgatttggctcaggatttaaaggacttgtaccataccccatcttttctgaacttttatccccttggtgaagatattgacattatttttaacttgaaaagcaccttcacagaacctgtcctgtggaggaaggaccaacaccatcaccgcgtggagcagctgaccctgaatggcctcctgcaggctcttcagagcccctgcatcattgaaggggaatctggcaaaggcaagtccactctgctgcagcgaattgccatgctctggggctccggaaagtgcaaggctctgaccaagttcaaattcgtcttcttcctccgtctcagcagggcccagggtggactttttgaaaccctctgtgatcaactcctggatatacctggcacaatcaggaagcagacattcatggccatgctgctgaagctgcggcagagggttcttttccttcttgatggctacaatgaattcaagccccagaactgcccagaaatcgaagccctgataaaggaaaaccaccgcttcaagaacatggtcatcgtcaccactaccactgagtgcctgaggcacatacggcagtttggtgccctgactgctgaggtgggggatatgacagaagacagcgcccaggctctcatccgagaagtgctgatcaaggagcttgctgaaggcttgttgctccaaattcagaaatccaggtgcttgaggaatctcatgaagacccctctctttgtggtcatcacttgtgcaatccagatgggtgaaagtgagttccactctcacacacaaacaacgctgttccataccttctatgatctgttgatacagaaaaacaaacacaaacataaaggtgtggctgcaagtgacttcattcggagcctggaccactgtggagacctagctctggagggtgtgttctcccacaagtttgatttcgaactgcaggatgtgtccagcgtgaatgaggatgtcctgctgacaactgggctcctctgtaaatatacagctcaaaggttcaagccaaagtataaattctttcacaagtcattccaggagtacacagcaggacgaagactcagcagtttattgacgtctcatgagccagaggaggtgaccaaggggaatggttacttgcagaaaatggtttccatttcggacattacatccacttatagcagcctgctccggtacacctgtgggtcatctgtggaagccaccagggctgttatgaagcacctcgcagcagtgtatcaacacggctgccttctcggactttccatcgccaagaggcctctctggagacaggaatctttgcaaagtgtgaaaaacaccactgagcaagaaattctgaaagccataaacatcaattcctttgtagagtgtggcatccatttatatcaagagagtacatccaaatcagccctgagccaagaatttgaagctttctttcaaggtaaaagcttatatatcaactcagggaacatccccgattacttatttgacttctttgaacatttgcccaattgtgcaagtgccctggacttcattaaactggacttttatgggggagctatggcttcatgggaaaaggctgcagaagacacaggtggaatccacatggaagaggccccagaaacctacattcccagcagggctgtatctttgttcttcaactggaagcaggaattcaggactctggaggtcacactccgggatttcagcaagttgaataagcaagatatcagatatctggggaaaatattcagctctgccacaagcctcaggctgcaaataaagagatgtgctggtgtggctggaagcctcagtttggtcctcagcacctgtaagaacatttattctctcatggtggaagccagtcccctcaccatagaagatgagaggcacatcacatctgtaacaaacctgaaaaccttgagtattcatgacctacagaatcaacggctgccgggtggtctgactgacagcttgggtaacttgaagaaccttacaaagctcataatggataacataaagatgaatgaagaagatgctataaaactagctgaaggcctgaaaaacctgaagaagatgtgtttatttcatttgacccacttgtctgacattggagagggaatggattacatagtcaagtctctgtcaagtgaaccctgtgaccttgaagaaattcaattagtctcctgctgcttgtctgcaaatgcagtgaaaatcctagctcagaatcttcacaatttggtcaaactgagcattcttgatttatcagaaaattacctggaaaaagatggaaatgaagctcttcatgaactgatcgacaggatgaacgtgctagaacagctcaccgcactgatgctgccctggggctgtgacgtgcaaggcagcctgagcagcctgttgaaacatttggaggaggtcccacaactcgtcaagcttgggttgaaaaactggagactcacagatacagagattagaattttaggtgcattttttggaaagaaccctctgaaaaacttccagcagttgaatttggcgggaaatcgtgtgagcagtgatggatggcttgccttcatgggtgtatttgagaatcttaagcaattagtgttttttgactttagtactaaagaatttctacctgatccagcattagtcagaaaacttagccaagtgttatccaagttaacttttctgcaagaagctaggcttgttgggtggcaatttgatgatgatgatctcagtgttattacaggtgcttttaaactagtaactgcttaaataaagtgtactcgaagcc

SEQ ID NO: 159650 - DNA, 6822 bp, Homo sapiens
  Payload ID: 11248
  Gene Symbol: NLRC5
  Gene Name: NLR family, CARD domain containing 5
  Uniprot ID: Q86WI3
  ENST ID: ENST00000262510
  CDS Start-End: 226-5826
gcagcagccgccagttccatgcactggcggagcagctctaggcggcggcttctactttcagtttcgtgcagagcgcggaggagccgcgagcgctgagggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattccacgtc

SEQ ID NO: 159651 - DNA, 6724 bp, Homo sapiens
  Payload ID: 11248
  Gene Symbol: NLRC5
  Gene Name: NLR family, CARD domain containing 5
  Uniprot ID: Q86WI3
  ENST ID: ENST00000436936
  CDS Start-End: 128-5728
gagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattccacgtc

SEQ ID NO: 159652 - DNA, 3430 bp, Homo sapiens
  Payload ID: 11248
  Gene Symbol: NLRC5
  Gene Name: NLR family, CARD domain containing 5
  ENST ID: ENST00000537056
  CDS Start-End: 1-976
gtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtgggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagctgaagcggtttcaaggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattccacgtc

SEQ ID NO: 159653 - DNA, 3617 bp, Homo sapiens
  Payload ID: 11248
  Gene Symbol: NLRC5
  Gene Name: NLR family, CARD domain containing 5
  ENST ID: ENST00000540182
  CDS Start-End: 1-1163
ctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggtctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagctgaagcggtttcaaggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattccacgtc

SEQ ID NO: 159654 - DNA, 594 bp, Homo sapiens
  Payload ID: 11248
  Gene Symbol: NLRC5
  Gene Name: NLR family, CARD domain containing 5
  ENST ID: ENST00000544641
  CDS Start-End: 371-594
acagatgaggacgctgaggtacgaagaggctgcgtaacctaccagggtcacacagctttggtgtggagtagggactcaaatccagggccctggtacggaggcatttgccctcaccaagattcaggcactgagagaagctgacgggcctagagaatggcaagacttgagatagcagaaggaaggagagagggtgagaaatggatccccgtgctgaggtctggtctggaaggagaagtctgcaaggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattg

SEQ ID NO: 159655 - DNA, 1894 bp, Homo sapiens
  Payload ID: 11248
  Gene Symbol: NLRC5
  Gene Name: NLR family, CARD domain containing 5
  ENST ID: ENST00000543030
  CDS Start-End: 1-1894
ctgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctgggcctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaagaaaaaaagaaagaaagaaagaaagaaggtttcagaggata

SEQ ID NO: 159656 - DNA, 550 bp, Homo sapiens
  Payload ID: 11248
  Gene Symbol: NLRC5
  Gene Name: NLR family, CARD domain containing 5
  ENST ID: ENST00000399221
  CDS Start-End: 1-472
tctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagactccacaaggcacacagagaaactgtccttccccacactggaggcctgtgctttgggatttaagaaaaaaagaaagaaagaaagaaagaaggtttcagaggatactgaactgaggacaaaaataaactgaaacgaagttct

SEQ ID NO: 159657 - DNA, 282 bp, Homo sapiens
  Payload ID: 11248
  Gene Symbol: NLRC5
  Gene Name: NLR family, CARD domain containing 5
  ENST ID: ENST00000538059
  CDS Start-End: 226-282
gtgtgactttatcctggaggcagtgggatgctgatagcaagttcagacaggcatgaggccagaccagagctgagttttcaagataactccagccagaggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgagg

SEQ ID NO: 159658 - DNA, 2656 bp, Homo sapiens
  Payload ID: 11248
  Gene Symbol: NLRC5
  Gene Name: NLR family, CARD domain containing 5
  ENST ID: ENST00000538110
  CDS Start-End: 1-2656
ctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtgggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaagaaaaaaa

SEQ ID NO: 159659 - DNA, 4777 bp, Homo sapiens
  Payload ID: 11248
  Gene Symbol: NLRC5
  Gene Name: NLR family, CARD domain containing 5
  Uniprot ID: Q86WI3
  ENST ID: ENST00000539881
  CDS Start-End: 261-2423
acgtgatttctcggcagcagccgccagttccatgcactggcggagcagctctaggcggcggcttctactttcagtttcgtgcagagcgcggaggagccgcgagcgctgagggtgagtgccgggagctctgagggagtctgcactatggaaacaacctgtcaatccagctcaaggcacacatagcccagacacccatgagaccctctccgtggggaccctagagcacctatcatgaacgaggagaccaaggctggctcctcatggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggtgagccaggccttggagctgagaagggtcttcagctggggatgcctggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggaaggaggaagttaagctgcagaaagataaacttgctcaaggccacacaggtaggaagagtctaggctagggttcaagcccagacagtctggctcgcagcctcatcctcataaccactgctacctctcttgctgagatctgccaagtagaaaccccaccacacctgggtctgccttccaaaccacagtccctcagggctccccccacccccttcatccttctcccagagtagagtgggataaccttctcttttcgggatggagaaattcccatggcgtccagcccctggctgaagccaataagagtagtgcttggggatggacggaggctctgtcacgaccctaggaggggcgcccctccaggaaacctccaagtgaacatgaaggcagatgatggaacgccaggatgtgttctgggtcgagtggccccacctcaggcctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaccctgccccatgagagtcccctggcctttggtagaaacttggctgtctctcggcagcccccagccttaggcagcgcatgtctcccactgggagatgctgtgctggactggggaagccttcacctgcaccatccactcaactcagggcacctgggagccctgtccacctccaaccccacccctggagcctcaccagggcacccacttgaacctgcctgcatggctggagcgtagcacttctgaaagcccttcctcaaggcacccccactctccttggggttaccacctcactcgccccagaacatctgggtctgtaaccagagactggacctggaatcaggactcttggctcaaaagggatttaactccccgggcctcagcttcttcatctgcacagtggatggtcagcctttccttttattgtcattgtggtgattctattatagtaattaccttaaaataaagaaatccaagacaaaacctgcctcacctaaacaacctcttctctcatcaaatccatgttgtcatgtgtccacaggactgtctactccttgcctatttgcatattcagtttctacctgtttgcagtcataaactagtttcatgcactgtg

SEQ ID NO: 159660 - DNA, 6505 bp, Homo sapiens
  Payload ID: 11248
  Gene Symbol: NLRC5
  Gene Name: NLR family, CARD domain containing 5
  Uniprot ID: Q86WI3
  ENST ID: ENST00000539144
  CDS Start-End: 1-5514
atggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggtctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattcc

SEQ ID NO: 159661 - DNA, 3552 bp, Homo sapiens
  Payload ID: 11248
  Gene Symbol: NLRC5
  Gene Name: NLR family, CARD domain containing 5
  ENST ID: ENST00000538805
  CDS Start-End: 1-3541
ccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtgggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagactccacaaggcacacagagaaactgtccttccccacactggaggcctgtgctttgggatttaagaaaaaaagaaagaaagaaagaaagaaggtttcagaggatactgaactgaggacaaaaataaactgaaacgaagttct

SEQ ID NO: 159662 - DNA, 5832 bp, Homo sapiens
  Payload ID: 11248
  Gene Symbol: NLRC5
  Gene Name: NLR family, CARD domain containing 5
  ENST ID: ENST00000545081
  CDS Start-End: 1-3172
gtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaagtgcctaggaagctggcatgtctgggcaccgtgcttccccaggcccttctctctgcagcctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattcc

SEQ ID NO: 159663 - DNA, 4121 bp, Homo sapiens
  Payload ID: 11248
  Gene Symbol: NLRC5
  Gene Name: NLR family, CARD domain containing 5
  ENST ID: ENST00000538453
  CDS Start-End: 1-2109
cagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcgcattcagagctcccaagacccagggcggctcctgcctgacctgttgccctttgacccccaccaggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctctggaataaccccattccctgcgacatggcccagcacctgaagagccaggagcccaggctggactttgccttctttgacaaccagccccaggccccttggggtacttgatggccccctcaagacctttggaatccagccaagtgatgcacccaaatgatccacctttcgcccactgggataattgactcaggaaagaagagcctcggcagggcgctctgcactccacccaggaggaaggatacgtgtgtcctgctgcagtcctcagggagaacttttttgggaaccaggagctgggtctggacaaaggagtaccctgcattacgtgggatatgtgtgatcaattggggacatgcgacacacaatgagggtgtcatgacaatgcatgacacgtacggttatatgtggcagtgtgaccccttgacatgtggcgttacatgaaagtcagtgtggcacgtgttctgtggcatgggtgctggcatcccaagtagcaggatacatgattgttggtctatatatgacacatgacaaatgtccatgtcacaggactcatggctggccagatgacctcaggctggcccaagatctaatttattaatttttaaagcaaatacatatttatagattgtgtgtatggagcagctaagtcaggaaaagtcttccgcccgagctgggaggggagagtgtccatgcactgaccagtccaggggctcaagggccagggctctggaacaagccagggactcagccattaagtcccctcctgcctcaatcctcagcctacccatctataaacttgatgactcctcccttacttacatactagcttccaaggacaggtggaggtagggccagcctggcgggagtggagaagcccagtctgtcctatgtaagggacaaagccaggtctaatggtactgggtagggggcactgccaagacaataagctaggctactgggtccagctactactttggtgggattcaggtgagtctccatgcacttcacatgttacccagtgttcttgttacttccaaggagaaccaagaatggctctgtcacactcgaagccaggcttgatcaataaacacaatggtattccacgtctagcgtg

SEQ ID NO: 159664 - DNA, 485 bp, Homo sapiens
  Payload ID: 11248
  Gene Symbol: NLRC5
  Gene Name: NLR family, CARD domain containing 5
  ENST ID: ENST00000545349
  CDS Start-End: 1-332
tggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagtctcactctgtcgcccaggctggagtgcagtggcatgatctcacttcactgcaacctctgcctcctgggttcaagcgattctggtgcctcagccgcccaagtagctgggattacagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctca

SEQ ID NO: 159665 - DNA, 5131 bp, Homo sapiens
  Payload ID: 11249
  Gene Symbol: NLRP1
  Gene Name: NLR family, pyrin domain containing 1
  Uniprot ID: Q9C000
  ENST ID: ENST00000262467
  CDS Start-End: 575-4702
gtgacgtttccttcctgctcttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcaggcaagagccacgaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaata

SEQ ID NO: 159666 - DNA, 5075 bp, Homo sapiens
  Payload ID: 11249
  Gene Symbol: NLRP1
  Gene Name: NLR family, pyrin domain containing 1
  Uniprot ID: Q9C000
  ENST ID: ENST00000269280
  CDS Start-End: 159-4448
tgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacaagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagtta

SEQ ID NO: 159667 - DNA, 4656 bp, Homo sapiens
  Payload ID: 11249
  Gene Symbol: NLRP1
  Gene Name: NLR family, pyrin domain containing 1
  Uniprot ID: Q9C000
  ENST ID: ENST00000345221
  CDS Start-End: 367-4656
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctga

SEQ ID NO: 159668 - DNA, 4332 bp, Homo sapiens
  Payload ID: 11249
  Gene Symbol: NLRP1
  Gene Name: NLR family, pyrin domain containing 1
  Uniprot ID: Q9C000
  ENST ID: ENST00000354411
  CDS Start-End: 1-4332
atggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctga

SEQ ID NO: 159669 - DNA, 5281 bp, Homo sapiens
  Payload ID: 11249
  Gene Symbol: NLRP1
  Gene Name: NLR family, pyrin domain containing 1
  Uniprot ID: Q9C000
  ENST ID: ENST00000544378
  CDS Start-End: 553-4680
gttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcaggcaagagccacgaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcagactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctcta

SEQ ID NO: 159670 - DNA, 555 bp, Homo sapiens
  Payload ID: 11249
  Gene Symbol: NLRP1
  Gene Name: NLR family, pyrin domain containing 1
  ENST ID: ENST00000576905
  CDS Start-End: 449-555
acttcttctctcctgccgccatttgaaggacgtgtctgcttccactcctgccgtgattgtcagcttcctgaggtctcctcagccatgctgaactgcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggag

SEQ ID NO: 159671 - DNA, 5444 bp, Homo sapiens
  Payload ID: 11249
  Gene Symbol: NLRP1
  Gene Name: NLR family, pyrin domain containing 1
  ENST ID: ENST00000571451
  CDS Start-End: 523-3676
gccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctac

SEQ ID NO: 159672 - DNA, 4200 bp, Homo sapiens
  Payload ID: 11249
  Gene Symbol: NLRP1
  Gene Name: NLR family, pyrin domain containing 1
  Uniprot ID: Q9C000
  ENST ID: ENST00000577119
  CDS Start-End: 1-4200
atggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctga

SEQ ID NO: 159673 - DNA, 4422 bp, Homo sapiens
  Payload ID: 11249
  Gene Symbol: NLRP1
  Gene Name: NLR family, pyrin domain containing 1
  Uniprot ID: Q9C000
  ENST ID: ENST00000572272
  CDS Start-End: 1-4422
atggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctga

SEQ ID NO: 159674 - DNA, 4788 bp, Homo sapiens
  Payload ID: 11249
  Gene Symbol: NLRP1
  Gene Name: NLR family, pyrin domain containing 1
  Uniprot ID: Q9C000
  ENST ID: ENST00000617618
  CDS Start-End: 367-4788
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctga

SEQ ID NO: 159675 - DNA, 4494 bp, Homo sapiens
  Payload ID: 11249
  Gene Symbol: NLRP1
  Gene Name: NLR family, pyrin domain containing 1
  Uniprot ID: Q9C000
  ENST ID: ENST00000613500
  CDS Start-End: 367-4494
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcaggcaagagccacgaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactag

SEQ ID NO: 159676 - DNA, 4698 bp, Homo sapiens
  Payload ID: 11249
  Gene Symbol: NLRP1
  Gene Name: NLR family, pyrin domain containing 1
  Uniprot ID: Q9C000
  ENST ID: ENST00000619223
  CDS Start-End: 367-4698
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctga

SEQ ID NO: 159677 - DNA, 2350 bp, Homo sapiens
  Payload ID: 11250
  Gene Symbol: NLRP10
  Gene Name: NLR family, pyrin domain containing 10
  Uniprot ID: Q86W26
  ENST ID: ENST00000328600
  CDS Start-End: 163-2130
ggagctttgcacatgtatctcgtctctccctggcctccgctctataacttggccaagcccccagaaagcagggtgggcctctcagcagtggacctctccttttgcctctttctccaggtcactggtcttctggtctggacttgatccttcccccagatcaccatggccatggccaaggccagaaagccccgggaggcattgctctgggccttgagtgaccttgaggagaacgatttcaagaagttaaagttctacttacgggatatgaccctgtctgagggccagcccccactggccagaggggagttggagggcctgattccggtggacctggcagaattactgatttcaaagtatggagaaaaggaggctgtgaaagttgtcctcaagggcttgaaggtcatgaacctgttggaacttgtggaccagctcagccatatttgtctgcatgattacagagaagtataccgagagcatgtgcgctgcctagaggaatggcaggaagcaggagtcaatggcagatacaaccaggtgctcctggtggccaagcccagctcagagagcccagaatcacttgcctgccccttcccggagcaggagctggagtctgtcacggtggaggctctatttgattcaggggaaaagccctcactggccccatccttagttgtgctacaggggtcggctggcactggaaagacaactctcgccagaaaaatggtgttggactgggccaccggtactctgtacccaggccggtttgattatgtcttttatgtaagctgcaaagaagtggtcctgctgctggagagcaaactggagcagctccttttctggtgctgcggggacaatcaagcccctgtcacagagattctgaggcagccagagcggctcctgttcatcctggatggctttgatgagctgcagaggccctttgaagaaaagttgaagaagaggggtttgagtcccaaggagagcctgctgcaccttctaattaggagacatacactccccacgtgctcccttctcatcaccacccggcccctggctttgaggaatctggagcccttgctgaaacaagcacgtcatgtccatatcctaggcttctctgaggaggagagggcgaggtacttcagctcctatttcacggatgagaagcaagctgaccgtgccttcgacattgtacagaaaaatgacattctctacaaagcgtgtcaggttccaggcatttgctgggtggtctgctcctggctgcaggggcagatggagagaggcaaagttgtcttagagacacctagaaacagcactgacatcttcatggcttacgtctccacctttctgccgcccgatgatgatgggggctgctccgagctttcccggcacagggtcctgaggagtctgtgctccctagcagctgaagggattcagcaccagaggttcctatttgaagaagctgagctcaggaaacataatttagatggccccaggcttgccgctttcctgagtagtaacgactaccaattgggacttgccatcaagaagttctacagcttccgccacatcagcttccaggacttttttcatgccatgtcttacctggtgaaagaggaccaaagccggctggggaaggagtcccgcagagaagtgcaaaggctgctggaggtaaaggagcaggaagggaatgatgagatgaccctcactatgcagtttttactggacatctcgaaaaaagacagcttctcgaacttggagctcaagttctgcttcagaatttctccctgtttagcgcaggatctgaagcattttaaagaacagatggaatctatgaagcacaacaggacctgggatttggaattctccctgtatgaagctaaaataaagaatctggtaaaaggtattcagatgaacaatgtatcattcaagataaaacattcaaatgaaaagaaatcacagagccagaatttattttctgtcaaaagcagcttgagtcatggacctaaggaggagcaaaaatgtccttctgtccatggacagaaggagggcaaagataatatagcaggaacacaaaaggaagcttctactggaaaaggcagagggacagaggaaacaccaaaaaatacttacatataaacctaattaaatatgtacaagatctctatgaggaaaatgacaacactctgaggaaagaaatcaaagaagctgtaaatgaatgggaagattttccatgttcatgaatagaaagactcaatattgttaagatgttagttttccccagtttgatctgtagattcaatgcaatcccaatcaagatcccagcaaataactttgtggacattgataagatgattct

SEQ ID NO: 159678 - DNA, 423 bp, Homo sapiens
  Payload ID: 11250
  Gene Symbol: NLRP10
  Gene Name: NLR family, pyrin domain containing 10
  ENST ID: ENST00000526590
  CDS Start-End: 227-423
caccaaacagaagtgaactagtgagtatgggctaagagagcccaaacttggacctgtagagctgtcggaccaggaaaggggatctgtttcgtctcagtccccaggctttgcttactgggctcctggatcagggagctgagttctcgctgcctcacctccagctccccaagtctgaactgtggtcactggtcttctggtctggacttgatccttcccccagatcaccatggccatggccaaggccagaaagccccgggaggcattgctctgggccttgagtgaccttgaggagaacgatttcaagaagttaaagttctacttacgggatatgaccctgtctgagggccagcccccactggccagaggggagttggagggcctgattccggtggacctggcagaattactgatttcaaagtatgg

SEQ ID NO: 159679 - DNA, 2350 bp, Homo sapiens; identical to SEQ ID NO: 159677
  Payload ID: 11250
  Gene Symbol: NLRP10
  Gene Name: NLR family, pyrin domain containing 10
  Uniprot ID: Q86W26
  ENST ID: ENST00000612291
  CDS Start-End: 163-2130

SEQ ID NO: 159680 - DNA, 423 bp, Homo sapiens; identical to SEQ ID NO: 159678
  Payload ID: 11250
  Gene Symbol: NLRP10
  Gene Name: NLR family, pyrin domain containing 10
  ENST ID: ENST00000629228
  CDS Start-End: 227-423

SEQ ID NO: 159681 - DNA, 2350 bp, Homo sapiens; identical to SEQ ID NO: 159677
  Payload ID: 11250
  Gene Symbol: NLRP10
  Gene Name: NLR family, pyrin domain containing 10
  Uniprot ID: Q86W26
  ENST ID: ENST00000625327
  CDS Start-End: 163-2130

SEQ ID NO: 159682 - DNA, 423 bp, Homo sapiens; identical to SEQ ID NO: 159678
  Payload ID: 11250
  Gene Symbol: NLRP10
  Gene Name: NLR family, pyrin domain containing 10
  ENST ID: ENST00000625936
  CDS Start-End: 227-423

SEQ ID NO: 159683 - DNA, 3417 bp, Homo sapiens
  Payload ID: 11251
  Gene Symbol: NLRP11
  Gene Name: NLR family, pyrin domain containing 11
  Uniprot ID: P59045
  ENST ID: ENST00000589093
  CDS Start-End: 95-3196
cgaccagccaaggagacctggtggcagggttgatctcatatttcttgtgcctcaaaatcccttctctgaagtctgccttccctggagaagcaagatggcagaatcggattctactgactttgacctgctgtggtatctagagaatctcagtgacaaggaatttcagagttttaagaagtatctggcacgcaagattcttgatttcaaactgccacagtttccactgatacagatgacaaaagaagaactggctaacgtgttgccaatctcttatgagggacagtatatatggaatatgctcttcagcatattttcaatgatgcgtaaggaagatctttgtaggaagatcattggcagacgaaaccgcaatcaggaggcatgcaaagctgtcatgaggagaaaattcatgctgcaatgggaaagtcacacttttggaaaatttcattataaattttttcgtgacgtttcgtcagatgtgttctacatacttcaattagcctatgattctaccagctattattcagcaaacaatctcaatgtgttcctgatgggagagagagcatctggaaaaactattgttataaatctggctgtgttgaggtggatcaagggtgagatgtggcagaacatgatctcgtacgtcgttcacctcactgctcacgaaataaaccagatgaccaacagcagcttggctgagctaatcgccaaggactggcctgacggccaggctcccattgcagacatcctgtctgatcccaagaaactccttttcatcctcgaggacttggacaacataagattcgagttaaatgtcaatgaaagtgctttgtgtagtaacagcacccagaaagttcccattccagttctcctggtcagtttgctgaagagaaaaatggctccaggctgctggttcctcatctcctcaaggcccacacgtgggaataatgtaaaaacgttcttgaaagaggtagattgctgcacgaccttgcagctgtcgaatgggaagagggagatatattttaactctttctttaaagaccgccagagggcgtcggcagccctccagcttgtacatgaggatgaaatactcgtgggtctgtgccgagtcgccatcttatgctggatcacgtgtactgtcctgaagcggcagatggacaaggggcgtgacttccagctctgctgccaaacacccactgatctacatgcccactttcttgctgatgcgttgacatcagaggctggacttactgccaatcagtatcacctaggtctcctaaaacgtctgtgtttgctggctgcaggaggactgtttctgagcaccctgaatttcagtggtgaagacctcagatgtgttgggtttactgaggctgatgtctctgtgttgcaggccgcgaatattcttttgccgagcaacactcataaagaccgttacaagttcatacacttgaacgtccaggagttttgtacagccattgcatttctgatggcagtacccaactatctgatcccctcaggcagcagagagtataaagagaagagagaacaatactctgactttaatcaagtgtttactttcatttttggtcttctaaatgcaaacaggagaaagattcttgagacatcctttggataccagctaccgatggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctagtcaaatgaagagccttgtctactggagagagatctgctctcttttttatacaatggagagcctccgggagctgcatatctttgacaatgaccttaatggtatttcagaaaggattctgtctaaagccctggagcattctagctgtaaacttcgcacactcaagttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagcttgatgaaatgtgatttgcgagccagcgaatgtgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcactgaaaattgctgcagcgcccttggaagagtgcttctgttcagcccaactctaagacaactagacctgtgtgtgaatcgcttaaaaaattacggagtgttgcatgtgacgtttcccttgctgtttccaacctgtcagttagaggagcttcatctgtctggctgtttctttagcagcgatatctgtcaatatattgccatagttattgctactaatgaaaaactgaggagcctggagattgggagcaacaaaatagaagatgcaggaatgcagctgctatgtggtggtttgagacatcccaactgcatgttggtgaatattgggctagaagagtgcatgttaaccagtgcctgctgtcgatctcttgcctctgttcttaccaccaacaaaacactagaaagactcaacttgcttcaaaatcacttgggcaatgatggagttgcaaaacttcttgagagcttgatcagcccagattgtgtacttaaggtagttgggcttccattaactggcctgaacacacaaacccagcagttgctgatgactgtaaaggaaagaaaacccagtttgatctttctgtctgaaacttggtctttaaaggaaggcagagaaattggtgtgacacctgcttctcagccaggttcaataatacctaattctaatttggattacatgtttttcaaatttcccagaatgtctgcagccatgagaacgtcaaatacagcatctaggcaacccctttgatcatgttgtacgtaaacagtatttattataaattactaccgtgactgggatgcaagagaattaggactataattttcctatttgatgtgtgtgtgtgtgtgtgtgtgtgtgtgtgtgtgtgtgtgtgtgtgaccttgatccagtcaaccacttcaaattcctacactgtctcaagagtattaaaaggattatatgaagtaataaaggataaaatgcattgg

SEQ ID NO: 159684 - DNA, 3777 bp, Homo sapiens
  Payload ID: 11251
  Gene Symbol: NLRP11
  Gene Name: NLR family, pyrin domain containing 11
  ENST ID: ENST00000590409
  CDS Start-End: 676-2640
ataaacacagggcgttcatctaccccactaactggagagaaggaaaacgctgggtaaatagaatggagaggcctggctgtgatcgatcagcctcaagaaaggagacagggtaaaagggagaaagaaaaggaagacccaaagtaacccaggaaatcagcacatagaagagacgaacagcccagcacgaagcgctgactcaccgctccacgccttcctggtccttaatgattggcggctggaagcgggaagaaaagatccgtggtgccatttgattggccaacgaattgctcccttgccattggctcagagggcttttgatgaacagatccagaaaatatgtgaagcgaaacgcccaccgccccttgaggggctgttctagacctttgctcctggtgtcgtatagagcgggggatatttcaagctggagatccgttttcttgtcccagtgaacaggtgcactatgttgaaataagagtggtgacggaggccttgtttatcttgtatcttattgtaaaaggtcatcaagaacccaccttggccaatcaagagaggagtcagctggctaatcaccgggcaggcaccgcctttttcttcccgctgcctagcttgtttgctttcgaccagccaaggagacctggtggcagggttggcaatcaggaggcatgcaaagctgtcatgaggagaaaattcatgctgcaatgggaaagtcacacttttggaaaatttcattataaattttttcgtgacgtttcgtcagatgtgttctacatacttcaattagcctatgattctaccagctattattcagcaaacaatctcaatgtgttcctgatgggagagagagcatctggaaaaactattgttataaatctggctgtgttgaggtggatcaagggtgagatgtggcagaacatgatctcgtacgtcgttcacctcactgctcacgaaataaaccagatgaccaacagcagcttggctgagctaatcgccaaggactggcctgacggccaggctcccattgcagacatcctgtctgatcccaagaaactccttttcatcctcgaggacttggacaacataagattcgagttaaatgtcaatgaaagtgctttgtgtagtaacagcacccagaaagttcccattccagttctcctggtcagtttgctgaagagaaaaatggctccaggctgctggttcctcatctcctcaaggcccacacgtgggaataatgtaaaaacgttcttgaaagaggtagattgctgcacgaccttgcagctgtcgaatgggaagagggagatatattttaactctttctttaaagaccgccagagggcgtcggcagccctccagcttgtacatgaggatgaaatactcgtgggtctgtgccgagtcgccatcttatgctggatcacgtgtactgtcctgaagcggcagatggacaaggggcgtgacttccagctctgctgccaaacacccactgatctacatgcccactttcttgctgatgcgttgacatcagaggctggacttactgccaatcagtatcacctaggtctcctaaaacgtctgtgtttgctggctgcaggaggactgtttctgagcaccctgaatttcagtggtgaagacctcagatgtgttgggtttactgaggctgatgtctctgtgttgcaggccgcgaatattcttttgccgagcaacactcataaagaccgttacaagttcatacacttgaacgtccaggagttttgtacagccattgcatttctgatggcagtacccaactatctgatcccctcaggcagcagagagtataaagagaagagagaacaatactctgactttaatcaagtgtttactttcatttttggtcttctaaatgcaaacaggagaaagattcttgagacatcctttggataccagctaccgatggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctagtcaaatgaagagccttgtctactggagagagatctgctctcttttttatacaatggagagcctccgggagctgcatatctttgacaatgaccttaatggtatttcagaaaggattctgtctaaagccctggagcattctagctgtaaacttcgcacactcaagttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagaatacacaggccaacgcgacggctcacgcctggaatcccaacactttgggaggccgaggcgggcagatcacctgagcttgatgaaatgtgatttgcgagccagcgaatgtgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcactgaaaattgctgcagcgcccttggaagagtgcttctgttcagcccaactctaagacaactagacctgtgtgtgaatcgcttaaaaaattacggagtgttgcatgtgacgtttcccttgctgtttccaacctgtcagttagaggagcttcatctgtctggctgtttctttagcagcgatatctgtcaatatattgccatagttattgctactaatgaaaaactgaggagcctggagattgggagcaacaaaatagaagatgcaggaatgcagctgctatgtggtggtttgagacatcccaactgcatgttggtgaatattgggctagaagagtgcatgttaaccagtgcctgctgtcgatctcttgcctctgttcttaccaccaacaaaacactagaaagactcaacttgcttcaaaatcacttgggcaatgatggagttgcaaaacttcttgagagcttgatcagcccagattgtgtacttaaggtagttgggcttccattaactggcctgaacacacaaacccagcagttgctgatgactgtaaaggaaagaaaacccagtttgatctttctgtctgaaacttggtctttaaaggaaggcagagaaattggtgtgacacctgcttctcagccaggttcaataatacctaattctaatttggattacatgtttttcaaatttcccagaatgtctgcagccatgagaacgtcaaatacagcatctaggcaacccctttgatcatgttgtacgtaaacagtatttattataaattactaccgtgactgggatgcaagagaattaggactataattttcctatttgatgtgtgtgtgtgtgtgtgtgtgtgtgtgtgtgtgtgtgtgtgtgtgaccttgatccagtcaaccacttcaaattcctacactgtctcaagagtattaaaaggattatatgaagtaataaaggataaaatgcattgg

SEQ ID NO: 159685 - DNA, 3064 bp, Homo sapiens
  Payload ID: 11251
  Gene Symbol: NLRP11
  Gene Name: NLR family, pyrin domain containing 11
  ENST ID: ENST00000593244
  CDS Start-End: 389-2644
agatccagaaaatatgtgaagcgaaacgcccaccgccccttgaggggctgttctagacctttgctcctggtgtcgtatagagcgggggatatttcaagctggagatccgttttcttgtcccagtgaacaggtgcactatgttgaaataagagtggtgacggaggccttgtttatcttgtatcttattgtaaaaggtcatcaagaacccaccttggccaatcaagagaggagtcagctggctaatcaccgggcaggcaccgcctttttcttcccgctgcctagcttgtttgctttcgaccagccaaggagacctggtggcagggttgatctcatatttcttgtgcctcaaaatcccttctctgaagtctgccttccctggagaagcaagatggcagaatcggattctactgactttgacctgctgtggtatctagagaatctcagtgacaaggaatttcagagttttaagaagtatctggcacgcaagattcttgatttcaaactgccacagtttccactgatacagatgacaaaagaagaactggctaacgtgttgccaatctcttatgagggacagtatatatggaatatgctcttcagcatattttcaatgatgcgtaaggaagatctttgtaggaagatcattggcagacgaaaccgcaatcaggaggcatgcaaagctgtcatgaggagaaaattcatgctgcaatgggaaagtcacacttttggaaaatttcattataaattttttcgtgacgtttcgtcagatgtgttctacatacttcaattagcctatgattctaccagctattattcagcaaacaatctcaatgtgttcctgatgggagagagagcatctggaaaaactattgttataaatctggctgtgttgaggtggatcaagggtgagatgtggcagaacatgatctcgtacgtcgttcacctcactgctcacgaaataaaccagatgaccaacagcagcttggctgagctaatcgccaaggactggcctgacggccaggctcccattgcagacatcctgtctgatcccaagaaactccttttcatcctcgaggacttggacaacataagattcgagttaaatgtcaatgaaagtgctttgtgtagtaacagcacccagaaagttcccattccagttctcctggtcagtttgctgaagagaaaaatggctccaggctgctggttcctcatctcctcaaggcccacacgtgggaataatgtaaaaacgttcttgaaagaggtagattgctgcacgaccttgcagctgtcgaatgggaagagggagatatattttaactctttctttaaagaccgccagagggcgtcggcagccctccagcttgtacatgaggatgaaatactcgtgggtctgtgccgagtcgccatcttatgctggatcacgtgtactgtcctgaagcggcagatggacaaggggcgtgacttccagctctgctgccaaacacccactgatctacatgcccactttcttgctgatgcgttgacatcagaggctggacttactgccaatcagtatcacctaggtctcctaaaacgtctgtgtttgctggctgcaggaggactgtttctgagcaccctgaatttcagtggtgaagacctcagatgtgttgggtttactgaggctgatgtctctgtgttgcaggccgcgaatattcttttgccgagcaacactcataaagaccgttacaagttcatacacttgaacgtccaggagttttgtacagccattgcatttctgatggcagtacccaactatctgatcccctcaggcagcagagagtataaagagaagagagaacaatactctgactttaatcaagtgtttactttcatttttggtcttctaaatgcaaacaggagaaagattcttgagacatcctttggataccagctaccgatggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctagtcaaatgaagagccttgtctactggagagagatctgctctcttttttatacaatggagagcctccgggagctgcatatctttgacaatgaccttaatggtatttcagaaaggattctgtctaaagccctggagcattctagctgtaaacttcgcacactcaagttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagatggagtttcgcccttgttgcccaggctagagtgcagtggcacagtctcagctcaccgcaacctctgacttccaggttcaagtgattcttttgcctcagcctcccaagtagctgggatttcaggccctcaacggctttcactttcattccaaatagaatacacaggccaacgcgacggctcacgcctggaatcccaacactttgggaggccgaggcgggcagatcacctgagcttgatgaaatgtgatttgcgagccagcgaatgtgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcactgaaaattgctgcagcgcccttggaagagtgcttctgttcagcccaactctaagacaactagacctgtgtgtgaatcgctt

SEQ ID NO: 159686 - DNA, 3231 bp, Homo sapiens
  Payload ID: 11251
  Gene Symbol: NLRP11
  Gene Name: NLR family, pyrin domain containing 11
  Uniprot ID: P59045
  ENST ID: ENST00000589824
  CDS Start-End: 64-3003
gatctcatatttcttgtgcctcaaaatcccttctctgaagtctgccttccctggagaagcaagatggcagaatcggattctactgactttgacctgctgtggtatctagagaatctcagtgacaaggaatttcagagttttaagaagtatctggcacgcaagattcttgatttcaaactgccacagtttccactgatacagatgacaaaagaagaactggctaacgtgttgccaatctcttatgagggacagtatatatggaatatgctcttcagcatattttcaatgatgcgtaaggaagatctttgtaggaagatcattggcagacgaaaccgcaatcaggaggcatgcaaagctgtcatgaggagaaaattcatgctgcaatgggaaagtcacacttttggaaaatttcattataaattttttcgtgacgtttcgtcagatgtgttctacatacttcaattagcctatgattctaccagctattattcagcaaacaatctcaatgtgttcctgatgggagagagagcatctggaaaaactattgttataaatctggctgtgttgaggtggatcaagggtgagatgtggcagaacatgatctcgtacgtcgttcacctcactgctcacgaaataaaccagatgaccaacagcagcttggctgagctaatcgccaaggactggcctgacggccaggctcccattgcagacatcctgtctgatcccaagaaactccttttcatcctcgaggacttggacaacataagattcgagttaaatgtcaatgaaagtgctttgtgtagtaacagcacccagaaagttcccattccagttctcctggtcagtttgctgaagagaaaaatggctccaggctgctggttcctcatctcctcaaggcccacacgtgggaataatgtaaaaacgttcttgaaagaggtagattgctgcacgaccttgcagctgtcgaatgggaagagggagatatattttaactctttctttaaagaccgccagagggcgtcggcagccctccagcttgtacatgaggatgaaatactcgtgggtctgtgccgagtcgccatcttatgctggatcacgtgtactgtcctgaagcggcagatggacaaggggcgtgacttccagctctgctgccaaacacccactgatctacatgcccactttcttgctgatgcgttgacatcagaggctggacttactgccaatcagtatcacctaggtctcctaaaacgtctgtgtttgctggctgcaggaggactgtttctgagcaccctgaatttcagtggtgaagacctcagatgtgttgggtttactgaggctgatgtctctgtgttgcaggccgcgaatattcttttgccgagcaacactcataaagaccgttacaagttcatacacttgaacgtccaggagttttgtacagccattgcatttctgatggcagtacccaactatctgatcccctcaggcagcagagagtataaagagaagagagaacaatactctgactttaatcaagtgtttactttcatttttggtcttctaaatgcaaacaggagaaagattcttgagacatcctttggataccagctaccgatggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctaggttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagcttgatgaaatgtgatttgcgagccagcgaatgtgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcactgaaaattgctgcagcgcccttggaagagtgcttctgttcagcccaactctaagacaactagacctgtgtgtgaatcgcttaaaaaattacggagtgttgcatgtgacgtttcccttgctgtttccaacctgtcagttagaggagcttcatctgtctggctgtttctttagcagcgatatctgtcaatatattgccatagttattgctactaatgaaaaactgaggagcctggagattgggagcaacaaaatagaagatgcaggaatgcagctgctatgtggtggtttgagacatcccaactgcatgttggtgaatattgggctagaagagtgcatgttaaccagtgcctgctgtcgatctcttgcctctgttcttaccaccaacaaaacactagaaagactcaacttgcttcaaaatcacttgggcaatgatggagttgcaaaacttcttgagagcttgatcagcccagattgtgtacttaaggtagttgggcttccattaactggcctgaacacacaaacccagcagttgctgatgactgtaaaggaaagaaaacccagtttgatctttctgtctgaaacttggtctttaaaggaaggcagagaaattggtgtgacacctgcttctcagccaggttcaataatacctaattctaatttggattacatgtttttcaaatttcccagaatgtctgcagccatgagaacgtcaaatacagcatctaggcaacccctttgatcatgttgtacgtaaacagtatttattataaattactaccgtgactgggatgcaagagaattaggactataattttcctatttgatgtgtgtgtgtgtgtgtgtgtgtgtgtgtgtgtgtgtgtgtgtgtgaccttgatccagtcaaccacttcaaattcctacactgtctcaagagtattaaaaggattatatgaagtaataaaggataaaatgcattggaaaaagc

SEQ ID NO: 159687 - DNA, 3077 bp, Homo sapiens
  Payload ID: 11251
  Gene Symbol: NLRP11
  Gene Name: NLR family, pyrin domain containing 11
  Uniprot ID: P59045
  ENST ID: ENST00000592953
  CDS Start-End: 52-2856
ccaaggagacctggtggcagggttggcaatcaggaggcatgcaaagctgtcatgaggagaaaattcatgctgcaatgggaaagtcacacttttggaaaatttcattataaattttttcgtgacgtttcgtcagatgtgttctacatacttcaattagcctatgattctaccagctattattcagcaaacaatctcaatgtgttcctgatgggagagagagcatctggaaaaactattgttataaatctggctgtgttgaggtggatcaagggtgagatgtggcagaacatgatctcgtacgtcgttcacctcactgctcacgaaataaaccagatgaccaacagcagcttggctgagctaatcgccaaggactggcctgacggccaggctcccattgcagacatcctgtctgatcccaagaaactccttttcatcctcgaggacttggacaacataagattcgagttaaatgtcaatgaaagtgctttgtgtagtaacagcacccagaaagttcccattccagttctcctggtcagtttgctgaagagaaaaatggctccaggctgctggttcctcatctcctcaaggcccacacgtgggaataatgtaaaaacgttcttgaaagaggtagattgctgcacgaccttgcagctgtcgaatgggaagagggagatatattttaactctttctttaaagaccgccagagggcgtcggcagccctccagcttgtacatgaggatgaaatactcgtgggtctgtgccgagtcgccatcttatgctggatcacgtgtactgtcctgaagcggcagatggacaaggggcgtgacttccagctctgctgccaaacacccactgatctacatgcccactttcttgctgatgcgttgacatcagaggctggacttactgccaatcagtatcacctaggtctcctaaaacgtctgtgtttgctggctgcaggaggactgtttctgagcaccctgaatttcagtggtgaagacctcagatgtgttgggtttactgaggctgatgtctctgtgttgcaggccgcgaatattcttttgccgagcaacactcataaagaccgttacaagttcatacacttgaacgtccaggagttttgtacagccattgcatttctgatggcagtacccaactatctgatcccctcaggcagcagagagtataaagagaagagagaacaatactctgactttaatcaagtgtttactttcatttttggtcttctaaatgcaaacaggagaaagattcttgagacatcctttggataccagctaccgatggtagacagcttcaagtggtactcggtgggatacatgaaacatttggaccgtgacccggaaaagttgacgcaccatatgcctttgttttactgtctctatgagaatcgggaagaagaatttgtgaagacgattgtggatgctctcatggaggttacagtttaccttcaatcagacaaggatatgatggtctcattatactgtctggattactgctgtcacctgaggacacttaagttgagtgttcagcgcatctttcaaaacaaagagccacttataaggccaactgctagtcaaatgaagagccttgtctactggagagagatctgctctcttttttatacaatggagagcctccgggagctgcatatctttgacaatgaccttaatggtatttcagaaaggattctgtctaaagccctggagcattctagctgtaaacttcgcacactcaagttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagcttgatgaaatgtgatttgcgagccagcgaatgtgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcactgaaaattgctgcagcgcccttggaagagtgcttctgttcagcccaactctaagacaactagacctgtgtgtgaatcgcttaaaaaattacggagtgttgcatgtgacgtttcccttgctgtttccaacctgtcagttagaggagcttcatctgtctggctgtttctttagcagcgatatctgtcaatatattgccatagttattgctactaatgaaaaactgaggagcctggagattgggagcaacaaaatagaagatgcaggaatgcagctgctatgtggtggtttgagacatcccaactgcatgttggtgaatattgggctagaagagtgcatgttaaccagtgcctgctgtcgatctcttgcctctgttcttaccaccaacaaaacactagaaagactcaacttgcttcaaaatcacttgggcaatgatggagttgcaaaacttcttgagagcttgatcagcccagattgtgtacttaaggtagttgggcttccattaactggcctgaacacacaaacccagcagttgctgatgactgtaaaggaaagaaaacccagtttgatctttctgtctgaaacttggtctttaaaggaaggcagagaaattggtgtgacacctgcttctcagccaggttcaataatacctaattctaatttggattacatgtttttcaaatttcccagaatgtctgcagccatgagaacgtcaaatacagcatctaggcaacccctttgatcatgttgtacgtaaacagtatttattataaattactaccgtgactgggatgcaagagaattaggactataattttcctatttgatgtgtgtgtgtgtgtgtgtgtgtgtgtgtgtgtgtgtgtgtgtgtgaccttgatccagtcaaccacttcaaattcctacactgtctcaagagtattaaaaggattatatgaagtaataaaggataaaatgcattgg

SEQ ID NO: 159688 - DNA, 416 bp, Homo sapiens
  Payload ID: 11251
  Gene Symbol: NLRP11
  Gene Name: NLR family, pyrin domain containing 11
  ENST ID: ENST00000593208
  CDS Start-End: 340-416
attcttctcacaggtctcaggctcctgggaggcaccttataaacacagggcgttcatctaccccactaactggagagaaggaaaacgctggatccgttttcttgtcccagtgaacaggtgcactatgttgaaataagagtggtgacggaggccttgtttatcttgtatcttattgtaaaaggtcatcaagaacccaccttggccaatcaagagaggagtcagctggctaatcaccgggcaggcaccgcctttttcttcccgctgcctagcttgtttgctttcgaccagccaaggagacctggtggcagggttggcaatcaggaggcatgcaaagctgtcatgaggagaaaattcatgctgcaatgggaaagtcacacttttggaaaatttcattataaattttttcgtgacgtttc

SEQ ID NO: 159689 - DNA, 3801 bp, Homo sapiens
  Payload ID: 11252
  Gene Symbol: NLRP12
  Gene Name: NLR family, pyrin domain containing 12
  Uniprot ID: P59046
  ENST ID: ENST00000324134
  CDS Start-End: 170-3355
ttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggttgggcatctgccggctgggctctgccgcctgtgagggtctttctgtggtgctccaggccaaccacaacctccgggagctggacttgagtttcaacgacctgggagactggggcctgtggttgctggctgaggggctgcaacatcccgcctgcagactccagaaactgtggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggcatggtggcgggcacctgtagtcccagctactcaggaggctgaggcaggagaatcgcttgaacccgggaggtggaggttgcagtgagccgagatcgcgccactgcactccagcctgggcgacagagtgggactccatctc

SEQ ID NO: 159690 - DNA, 3547 bp, Homo sapiens
  Payload ID: 11252
  Gene Symbol: NLRP12
  Gene Name: NLR family, pyrin domain containing 12
  ENST ID: ENST00000345770
  CDS Start-End: 221-3241
attggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctcagaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggttgggcatctgccggctgggctctgccgcctgtgagggtctttctgtggtgctccaggccaaccacaacctccgggagctggacttgagtttcaacgacctgggagactggggcctgtggttgctggctgaggggctgcaacatcccgcctgcagactccagaaactgtggtggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccagg

SEQ ID NO: 159691 - DNA, 3205 bp, Homo sapiens
  Payload ID: 11252
  Gene Symbol: NLRP12
  Gene Name: NLR family, pyrin domain containing 12
  ENST ID: ENST00000391772
  CDS Start-End: 221-2899
attggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctcagaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggtggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccagg

SEQ ID NO: 159692 - DNA, 3715 bp, Homo sapiens
  Payload ID: 11252
  Gene Symbol: NLRP12
  Gene Name: NLR family, pyrin domain containing 12
  Uniprot ID: P59046
  ENST ID: ENST00000391773
  CDS Start-End: 221-3409
attggtgagtggggcagggcaggagggaactgaagagtgagaaagcattatttcagcaaaaggtctttcctcccttgctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctcagaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggttgggcatctgccggctgggctctgccgcctgtgagggtctttctgtggtgctccaggccaaccacaacctccgggagctggacttgagtttcaacgacctgggagactggggcctgtggttgctggctgaggggctgcaacatcccgcctgcagactccagaaactgtggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccagg

SEQ ID NO: 159693 - DNA, 3465 bp, Homo sapiens
  Payload ID: 11252
  Gene Symbol: NLRP12
  Gene Name: NLR family, pyrin domain containing 12
  Uniprot ID: P59046
  ENST ID: ENST00000391775
  CDS Start-End: 144-3158
ctctctcctccaaccactggctcagcctctccgcccgctgcctgtgaatgatgcaatggaaggtgtgctggggtcgccctgtgtcccgtgcataggagcatctcagcctccaggtcctctcctttggggctcacggcacccccatgctacgaaccgcaggcagggacggcctctgtcgcctgtccacctacttggaagaactcgaggctgtggaactgaagaagttcaagttatacctggggaccgcgacagagctgggagaaggcaagatcccctggggaagcatggagaaggccggtcccctggaaatggcccagctgctcatcacccacttcgggccagaggaggcctggaggttggctctcagcacctttgagcggataaacaggaaggacctgtgggagagaggacagagagaggacctggtgagggataccccacctggtggcccgtcctcacttgggaaccagtcaacatgccttctggaagtctctcttgtcactccaagaaaagatccccaggaaacctacagggactatgtccgcaggaaattccggctcatggaagaccgcaatgcgcgcctaggggaatgtgtcaacctcagccaccggtacacccggctcctgctggtgaaggagcactcaaaccccatgcaggtccagcagcagcttctggacacaggccggggacacgcgaggaccgtgggacaccaggctagccccatcaagatagagaccctctttgagccagacgaggagcgccccgagccaccgcgcaccgtggtcatgcaaggcgcggcagggataggcaagtccatgctggcacacaaggtgatgctggactgggcggacgggaagctcttccaaggcagatttgattatctcttctacatcaactgcagggagatgaaccagagtgccacggaatgcagcatgcaagacctcatcttcagctgctggcctgagcccagcgcgcctctccaggagctcatccgagttcccgagcgcctccttttcatcatcgacggcttcgatgagctcaagccttctttccacgatcctcagggaccctggtgcctctgctgggaggagaaacggcccacggagctgcttcttaacagcttaattcggaagaagctgctccctgagctatctttgctcatcaccacacggcccacggctttggagaagctccaccgtctgctggagcaccccaggcatgtggagatcctgggcttctctgaggcagaaaggaaggaatacttctacaagtatttccacaatgcagagcaggcgggccaagtcttcaattacgtgagggacaacgagcctctcttcaccatgtgcttcgtccccctggtgtgctgggtggtgtgtacctgcctccagcagcagctggagggtggggggctgttgagacagacgtccaggaccaccactgcagtgtacatgctctacctgctgagtctgatgcaacccaagccgggggccccgcgcctccagcccccacccaaccagagagggttgtgctccttggcggcagatgggctctggaatcagaaaatcctatttgaggagcaggacctccggaagcacggcctagacggggaagacgtctctgccttcctcaacatgaacatcttccagaaggacatcaactgtgagaggtactacagcttcatccacttgagtttccaggaattctttgcagctatgtactatatcctggacgagggggagggcggggcaggcccagaccaggacgtgaccaggctgttgaccgagtacgcgttttctgaaaggagcttcctggcactcaccagccgcttcctgtttggactcctgaacgaggagaccaggagccacctggagaagagtctctgctggaaggtctcgccgcacatcaagatggacctgttgcagtggatccaaagcaaagctcagagcgacggctccaccctgcagcagggctccttggagttcttcagctgcttgtacgagatccaggaggaggagtttatccagcaggccctgagccacttccaggtgatcgtggtcagcaacattgcctccaagatggagcacatggtctcctcgttctgtctgaagcgctgcaggagcgcccaggtgctgcacttgtatggcgccacctacagcgcggacggggaagaccgcgcgaggtgctccgcaggagcgcacacgctgttggtgcagctaccagagaggaccgttctgctggacgcctacagtgaacatctggcagcggccctgtgcaccaatccaaacctgatagagctgtctctgtaccgaaatgccctgggcagccggggggtgaagctgctctgtcaaggactcagacaccccaactgcaaacttcagaacctgaggctgaagaggtgccgcatctccagctcagcctgcgaggacctctctgcagctctcatagccaataagaatttgacaaggatggatctcagtggcaacggcgttggattcccaggcatgatgctgctttgcgagggcctgcggcatccccagtgcaggctgcagatgattcagttgaggaagtgtcagctggagtccggggcttgtcaggagatggcttctgtgctcggcaccaacccacatctggttgagttggacctgacaggaaatgcactggaggatttgggcctgaggttactatgccagggactgaggcacccagtctgcagactacggactttgtggctgaagatctgccgcctcactgctgctgcctgtgacgagctggcctcaactctcagtgtgaaccagagcctgagagagctggacctgagcctgaatgagctgggggacctcggggtgctgctgctgtgtgagggcctcaggcatcccacgtgcaagctccagaccctgcggctggatagctgtggcctcacagccaaggcttgtgagaatctttacttcaccctggggatcaaccagaccttgaccgacctttacctgaccaacaacgccctaggggacacaggtgtccgactgctttgcaagcggctgagccatcctggctgcaaactccgagtcctctggttatttgggatggacctgaataaaatgacccacagtaggttggcagcgcttcgagtaacaaaaccttatttggacattggctgctgaatggtcctatctgctggctctcccctgagatctggacagaggaagatgggagggtgctcatcacccccccagcataatgatcagcctccttcctagagacagactcatgcagattgagatcaaaagtccctctgcttgggatcaaattaatgtttgacagagctggccaggcgtggtggctcatgtatgtaatcctagcacttcgagaggccgaggcaggtggatcacgaggtcaggagtttgagattagcctggccaagatggtgaaaccctgtctctactaaaaataaaaaaaaattagccaggc

SEQ ID NO: 159694 - DNA, 3132 bp, Homo sapiens
  Payload ID: 11253
  Gene Symbol: NLRP13
  Gene Name: NLR family, pyrin domain containing 13
  Uniprot ID: Q86W25
  ENST ID: ENST00000342929
  CDS Start-End: 1-3132
atgaacttttctgtaatcacctgccccaacggtggtaccaaccaagggcttctgccttacctgatggccctggatcagtatcagctggaggaattcaagctttgcttggaaccccagcagctgatggacttctggtcggccccccaggggcacttcccgcgtatcccctgggcaaacttgagagctgccgaccctttgaatctgtcctttcttttggatgaacacttcccaaaaggtcaggcatggaaagtggtcctcggcatcttccagacaatgaatctgacctcactgtgtgagaaagttagagccgagatgaaagagaatgtgcagacccaagagctgcaagatccaacccaggaagatctagagatgctagaagcagcagcagggaatatgcagacccagggatgccaagatccaaaccaagaagaactagacgagctagaagaagaaacagggaatgtacaggcccagggatgccaagatccaaaccaagaagaaccagagatgctagaggaagcagaccacagaagaaaatacagagagaacatgaaggctgaactactggagacatgggacaacatcagttggcctaaagaccacgtatatatccgtaatacatcaaaggacgaacatgaggaactgcagcgcctactggatcctaataggactagagcccaggcccagacgatagtcttggtggggagggcaggggttgggaagaccaccttggcaatgcaggctatgctgcactgggcaaatggagttctctttcagcaaaggttctcctatgttttctatctcagctgccataaaataaggtacatgaaggaaactacctttgctgaattgatttctttggattggcccgattttgatgcccccattgaagagttcatgtctcaaccagagaagctcctgtttattattgatggctttgaggaaataatcatatctgagtcacgctctgagagcttggatgatggctcgccatgtacagactggtaccaggagctcccagtgaccaaaatcctacacagcttgttgaagaaagaattggttcccctggctaccttactgatcacgatcaagacctggtttgtgagagatcttaaggcctcattagtgaatccatgctttgtacaaattacagggttcacaggggacgacctacgggtatatttcatgagacactttgatgactcaagtgaagttgagaaaatcctgcagcagctaagaaaaaacgaaactctctttcattcctgcagtgcccccatggtgtgttggaccgtatgttcctgtctgaagcagccgaaggtgaggtattacgatctccagtcaatcactcagactaccaccagtctgtatgcctattttttctccaacttgttctccacagcagaggtagatttggcagatgacagctggccaggacaatggagggccctctgcagtctggccatagaagggctgtggtctatgaacttcacgtttaacaaagaagacactgagatcgagggcctggaagtgcctttcattgattctctctacgagttcaatattcttcaaaagatcaatgactgtgggggttgcactactttcacccacctaagtttccaggagttttttgcagccatgtcctttgtgctagaggaacctagagaattccctccccattccacaaagccacaagagatgaagatgttactgcaacacgtcttgcttgacaaagaagcctactggactccagtggttctgttcttctttggtcttttaaataaaaacatagcaagagaactggaagatactttgcattgtaaaatatctcccagggtaatggaggaattattaaagtggggagaagagttaggtaaggctgaaagtgcctctctccaatttcacattctacgactttttcactgcctacacgagtcccaggaggaagacttcacaaagaagatgttgggtcgtatctttgaagttgaccttaatattttggaggacgaagaactccaagcttcttcattttgcctaaagcactgtaaaaggttaaataagctaaggctttctgttagcagtcacatccttgaaagggacttggaaattctggagacaagcaagtttgattccaggatgcacgcatggaacagcatttgctctacgttggtcacaaatgagaatctgcatgagctagacctgagtaacagcaaacttcatgcttcctctgtgaagggtctctgtcttgcactgaaaaatccaagatgcaaagtccagaaactgacgtgcaaatcggtaactcctgagtgggttctgcaggacctcattattgcccttcagggtaacagcaagctgacccatctgaacttcagctctaacaagctgggaatgactgtccccctgattcttaaagctttgagacactcagcttgcaacctcaagtatctgtgcctggagaaatgcaacttgtcggcagccagctgtcaggacctagccttgtttctcaccagcatccaacacgtaactcgattgtgcctgggatttaatcggctccaagatgatggcataaagctattgtgtgcggccctgactcaccccaagtgtgccttagagagactggagctctggttttgccagctggcagcacccgcttgcaagcacttgtcagatgctctcctgcagaacaggagcctgacacacctgaatctgagcaagaacagcctgagagacgagggagtcaagttcctgtgtgaggccttgggtcgcccagatggtaacctgcagagcctgaatttgtcaggttgttctttcacaagagagggctgtggagagctggctaatgccctcagccataatcataatgtgaaaatcttggatttgggagaaaatgatcttcaggatgatggagtgaagctactgtgtgaggctctgaaaccacatcgtgcattgcacacacttgggttggcgaaatgcaatctgacaactgcttgctgccagcatctcttctctgttctcagcagcagtaagagcctggtcaatctgaaccttctaggcaatgaattggatactgatggtgtcaagatgctatgtaaggctttgaaaaagtcgacatgcaggctgcagaaactcgggtaa

SEQ ID NO: 159695 - DNA, 3533 bp, Homo sapiens
  Payload ID: 11253
  Gene Symbol: NLRP13
  Gene Name: NLR family, pyrin domain containing 13
  ENST ID: ENST00000588751
  CDS Start-End: 26-3136
tgagaaactgcatgtgttgggcaagatgaacttttctgtaatcacctgccccaacggtggtaccaaccaagggcttctgccttacctgatggccctggatcagtatcagctggaggaattcaagctttgcttggaaccccagcagctgatggacttctggtcggccccccaggggcacttcccgcgtatcccctgggcaaacttgagagctgccgaccctttgaatctgtcctttcttttggatgaacacttcccaaaaggtcaggcatggaaagtggtcctcggcatcttccagacaatgaatctgacctcactgtgtgagaaagttagagccgagatgaaagagaatgtgcagacccaagagctgcaagatccaacccaggaagatctagagatgctagaagcagcagcagggaatatgcagacccagggatgccaagatccaaaccaagaagaactagacgagctagaagaagaaacagggaatgtacaggcccagggatgccaagatccaaaccaagaagaaccagagatgctagaggaagcagaccacagaagaaaatacagagagaacatgaaggctgaactactggagacatgggacaacatcagttggcctaaagaccacgtatatatccgtaatacatcaaaggacgaacatgaggaactgcagcgcctactggatcctaataggactagagcccaggcccagacgatagtcttggtggggagggcaggggttgggaagaccaccttggcaatgcaggctatgctgcactgggcaaatggagttctctttcagcaaaggttctcctatgttttctatctcagctgccataaaataaggtacatgaaggaaactacctttgctgaattgatttctttggattggcccgattttgatgcccccattgaagagttcatgtctcaaccagagaagctcctgtttattattgatggctttgaggaaataatcatatctgagtcacgctctgagagcttggatgatggctcgccatgtacagactggtaccaggagctcccagtgaccaaaatcctacacagcttgttgaagaaagaattggttcccctggctaccttactgatcacgatcaagacctggtttgtgagagatcttaaggcctcattagtgaatccatgctttgtacaaattacagggttcacaggggacgacctacgggtatatttcatgagacactttgatgactcaagtgaagttgagaaaatcctgcagcagctaagaaaaaacgaaactctctttcattcctgcagtgcccccatggtgtgttggaccgtatgttcctgtctgaagcagccgaaggtgaggtattacgatctccagtcaatcactcagactaccaccagtctgtatgcctattttttctccaacttgttctccacagcagaggtagatttggcagatgacagctggccaggacaatggagggccctctgcagtctggccatagaagggctgtggtctatgaacttcacgtttaacaaagaagacactgagatcgagggcctggaagtgcctttcattgattctctctacgagttcaatattcttcaaaagatcaatgactgtgggggttgcactactttcacccacctaagtttccaggagttttttgcagccatgtcctttgtgctagaggaacctagagaattccctccccattccacaaagccacaagagatgaagatgttactgcaacacgtcttgcttgacaaagaagcctactggactccagtggttctgttcttctttggtcttttaaataaaaacatagcaagagaactggaagatactttgcattgtaaaatatctcccagggtaatggaggaattattaaagtggggagaagagttaggtaaggctgaaagtgcctctctccaatttcacattctacgactttttcactgcctacacgagtcccaggaggaagacttcacaaagaagatgttgggtcgtatctttgaagttgaccttaatattttggaggacgaagaactccaagcttcttcattttgcctaaagcactgtaaaaggttaaataagctaaggctttctgttagcagtcacatccttgaaagggacttggaaattctggagacaagcaagtttgattccaggatgcacgcatggaacagcatttgctctacgttggtcacaaatgagaatctgcatgagctagacctgagtaacagcaaacttcatgcttcctctgtgaagggtctctgtcttgcactgaaaaatccaagatgcaaagtccagaaactgacgtgcaaatcggtaactcctgagtgggttctgcaggacctcattattgcccttcagggtaacagcaagctgacccatctgaacttcagctctaacaagctgggaatgactgtccccctgattcttaaagctttgagacactcagcttgcaacctcaagtatctgtgcctggagaaatgcaacttgtcggcagccagctgtcaggacctagccttgtttctcaccagcatccaacacgtaactcgattgtgcctgggatttaatcggctccaagatgatggcataaagctattgtgtgcggccctgactcaccccaagtgtgccttagagagactggagctctggttttgccagctggcagcacccgcttgcaagcacttgtcagatgctctcctgcagaacaggagcctgacacacctgaatctgagcaagaacagcctgagagacgagggagtcaagttcctgtgtgaggccttgggtcgcccagatggtaacctgcagagcctgaatttgtcaggttgttctttcacaagagagggctgtggagagctggctaatgccctcagccataatcataatgtgaaaatcttggatttgggagaaaatgatcttcaggatgatggagtgaagctactgtgtgaggctctgaaaccacatcgtgcattgcacacacttgggttggcgaaatgcaatctgacaactgcttgctgccagcatctcttctctgttctcagcagcagtaagagcctggtcaatctgaaccttctaggcaatgaattggatactgatggtgtcaagatgctatgcttcaaaaagacctgcacaatgtagtgagagaggagatacagacctcacagaaggagctctgtctgaaactcaagtgtgcgtgggattttaatgaccttgaagacaagtggtggtggtgatcccacggattagatgccacgtggcttgaccatggatcttgggggaaagccaccaggacatcctggcctgtgtgtcgctccaatgtcaccatttgtggggacaaatgagctgttccctgcaggaggctttgtcacggttgttggaggccgcccattgcacgcccaggtctggaatcctagtgtaatactgtgtctggtaccaagatcataagttggctgtgccttcagtcttgtctatgtcctccttggtgtaatgtttttaattcttggaggtgttgagagaattcaataaagcaaagcat

SEQ ID NO: 159696 - DNA, 3628 bp, Homo sapiens
  Payload ID: 11254
  Gene Symbol: NLRP14
  Gene Name: NLR family, pyrin domain containing 14
  Uniprot ID: Q86W24
  ENST ID: ENST00000299481
  CDS Start-End: 347-3628
gtatcccgcgcctcccgacctttggccgctggcattcctgcgcgggcgggagctgcgggcgctcgggggataaggcgaggacgcaccagcattaatggaataggagaactcccgaagcttttagggccctgggaaagggggcgtggctggaaacggagctactggcttcggagaattctgtgaccctcaccaccgcgacgaccccgaggaaacgctgtcaggtcgcctttggttggcaaggcgtggttgtcctcgctgtcccgcgccttggcggaatgggcacctcactagccctggcactagctagcatcgctctaaactcaagaggcctgaatatttggacaagatggcagattcatcatcatcttctttctttcctgattttgggctgctattgtatttggaggagctaaacaaagaggaattaaatacattcaagttattcctaaaggagaccatggaacctgagcatggcctgacaccctggaatgaagtgaagaaggccaggcgggaggacctggccaatttgatgaagaaatattatccaggagagaaagcctggagtgtgtctctcaaaatctttggcaagatgaacctgaaggatctgtgtgagagagcgaaagaagagatcaactggtcggcccagactataggaccagatgatgccaaggctggagagacacaagaagatcaggaggcagtgctgggtgatggaacagaatacagaaatagaataaaggaaaaattttgcatcacttgggacaagaagtctttggctggaaagcctgaagatttccatcatggaattgcagagaaagatagaaaactgttggaacacttgttcgatgtggatgtcaaaaccggtgcacagccacagatcgtggtgcttcagggagctgctggagttgggaaaacaaccttggtgagaaaggcaatgttagattgggcagagggcagtctctaccagcagaggtttaagtatgttttttatctcaatgggagagaaattaaccagctgaaagagagaagctttgctcaattgatatcaaaggactggcccagcacagaaggccccattgaagaaatcatgtaccagccaagtagcctcttgtttattattgacagtttcgatgaactgaactttgcctttgaagaacctgagtttgcactgtgcgaagactggacccaagaacacccagtgtccttcctcatgagtagtttgctgaggaaagtgatgctccctgaggcatccttattggtgacaacaagactcacaacttctaagagactaaagcagttgttgaagaatcaccattatgtagagctactaggaatgtctgaggatgcaagagaggagtatatttaccagttttttgaagataagaggtgggccatgaaagtattcagttcactaaaaagcaatgagatgctgtttagcatgtgccaagtccccctagtgtgctgggccgcttgtacttgtctgaagcagcaaatggagaagggtggtgatgtcacattgacctgccaaacaaccacagctctgtttacctgctatatttctagcttgttcacaccagtagatggaggctctcctagtctacccaaccaagcccagctgagaagactgtgccaagtcgctgccaaaggaatatggactatgacttacgtgttttacagagaaaatctcagaaggcttgggttaactcaatctgatgtctctagttttatggacagcaatattattcagaaggacgcagagtatgaaaactgctatgtgttcacccaccttcatgttcaggagttttttgcagctatgttctatatgttgaaaggcagttgggaagctgggaacccttcctgccagccttttgaagatttgaagtcattacttcaaagcacaagttataaagacccccatttgacacagatgaagtgctttttgtttggccttttgaatgaagatcgagtaaaacaactggagaggacttttaactgtaaaatgtcactgaagataaaatcaaagttacttcagtgtatggaagtattaggaaacagtgactattctccatcacagctgggatttctggagttgtttcactgtctgtatgagactcaagataaagcgtttataagccaggcaatgagatgtttcccaaaggttgccattaatatttgtgagaaaatacatttgcttgtatcttctttctgccttaagcactgccggtgtttgcggaccatcaggctgtctgtaactgtggtatttgagaagaagatattaaaaacaagcctcccaactaacacttgggatggtgatcgcattactcactgttggcaagatctctgttctgtgcttcatacaaatgaacacttgagagaattggacctgtaccatagcaaccttgataaatcagcaatgaatatcctgcatcatgaactaaggcacccaaactgtaaactacaaaagctactgttgaaatttatcactttccctgatggttgtcaggatatctctacttctttgattcataacaagaatctgatgcatcttgacctaaaagggagtgatataggggataatggagtaaagtcattgtgtgaggccttgaaacacccagagtgtaaactacagactctcaggctggaatcttgcaacctaactgtattttgttgtctaaatatatctaatgctctcatcagaagccagagcctgatatttctgaatctgtcaaccaataatctgttggatgatggagtgcagcttttgtgtgaggccttaagacatccaaagtgttatctagagagactgtccttagaaagctgtggtctcacagaggctggctgtgagtatctttctttggctctcatcagcaataaaagactgacacatttgtgcttggcagacaatgtcttgggtgatggtggagtaaagcttatgagtgatgccctgcaacatgcacaatgtactctgaagagccttgtgctgaggcgttgccatttcacttcacttagcagtgaatatctgtcaacttctcttctacacaacaagagcctgacgcatctggatctaggatcaaactggctacaagacaatggagtgaagcttctgtgtgatgtctttcggcatccaagctgtaatcttcaggacttggaattgatgggctgtgttctcactaatgcatgttgtctggatctggcttctgttattttgaataacccaaacctgaggagcctggaccttgggaacaacgatttgcaggatgatggagtgaaaattctgtgtgatgctttgagatatccaaactgtaacattcagaggctcgggttggaatactgtggtttgacatctctctgctgtcaagatctctcctctgctcttatctgcaacaaaagactgataaaaatgaatctgacacagaataccttaggatatgaaggaattgtgaagttatataaagtcttgaagtctcctaagtgtaaactacaagttctagggttgtgcaaagaggcatttgatgaggaagcccagaagctgctggaagctgtgggagttagcaatccacacttaatcattaagccagattgtaactatcataatgaagaagatgtgtcttggtggtggtgtttctga

SEQ ID NO: 159697 - DNA, 3496 bp, Homo sapiens
  Payload ID: 11255
  Gene Symbol: NLRP2
  Gene Name: NLR family, pyrin domain containing 2
  ENST ID: ENST00000263437
  CDS Start-End: 80-3259
attagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcac

SEQ ID NO: 159698 - DNA, 3422 bp, Homo sapiens
  Payload ID: 11255
  Gene Symbol: NLRP2
  Gene Name: NLR family, pyrin domain containing 2
  Uniprot ID: Q9NX02
  ENST ID: ENST00000339757
  CDS Start-End: 60-3182
cagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 159699 - DNA, 3420 bp, Homo sapiens
  Payload ID: 11255
  Gene Symbol: NLRP2
  Gene Name: NLR family, pyrin domain containing 2
  Uniprot ID: Q9NX02
  ENST ID: ENST00000391721
  CDS Start-End: 67-3183
caacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcac

SEQ ID NO: 159700 - DNA, 3411 bp, Homo sapiens
  Payload ID: 11255
  Gene Symbol: NLRP2
  Gene Name: NLR family, pyrin domain containing 2
  Uniprot ID: Q9NX02
  ENST ID: ENST00000427260
  CDS Start-End: 112-3231
aatcacagggctgcggccgagagagaagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgtta

SEQ ID NO: 159701 - DNA, 3573 bp, Homo sapiens
  Payload ID: 11255
  Gene Symbol: NLRP2
  Gene Name: NLR family, pyrin domain containing 2
  Uniprot ID: Q9NX02
  ENST ID: ENST00000448584
  CDS Start-End: 143-3331
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 159702 - DNA, 3507 bp, Homo sapiens
  Payload ID: 11255
  Gene Symbol: NLRP2
  Gene Name: NLR family, pyrin domain containing 2
  Uniprot ID: Q9NX02
  ENST ID: ENST00000537859
  CDS Start-End: 143-3265
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 159703 - DNA, 550 bp, Homo sapiens
  Payload ID: 11255
  Gene Symbol: NLRP2
  Gene Name: NLR family, pyrin domain containing 2
  ENST ID: ENST00000397169
  CDS Start-End: 56-550
acaaagaagattgtgctaaggcttgagtgccttgagcccaactgcagatctaagaatgctggctattaaaagatacaagcagccaagcgcggtggctcacgcctgtaatcccaacactttgggaggccgagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggac

SEQ ID NO: 159704 - DNA, 577 bp, Homo sapiens
  Payload ID: 11255
  Gene Symbol: NLRP2
  Gene Name: NLR family, pyrin domain containing 2
  ENST ID: ENST00000539848
  CDS Start-End: 52-381
atctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattaggctgaagtgcagtggagcgatcttggctcactgcaatctccgcctcctgggttcaagcaattcccttgcctcagcctcgcaagtagctgggacttacagggataacacggaaagaacgaccacctctagacgtggacgaaatgctggagcgcttcaaaacagaagcacaagcgtttacagaaacgaaaggaaatgtcatct

SEQ ID NO: 159705 - DNA, 540 bp, Homo sapiens
  Payload ID: 11255
  Gene Symbol: NLRP2
  Gene Name: NLR family, pyrin domain containing 2
  ENST ID: ENST00000433772
  CDS Start-End: 78-540
agtgtaaccaatcaagcagaatctctaggcgttcgtgctttgaaatgaggctccacatagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccag

SEQ ID NO: 159706 - DNA, 3576 bp, Homo sapiens
  Payload ID: 11255
  Gene Symbol: NLRP2
  Gene Name: NLR family, pyrin domain containing 2
  Uniprot ID: Q9NX02
  ENST ID: ENST00000543010
  CDS Start-End: 144-3332
aagtgctcagcaacgattacgccccgagggccaatcacagggctgcggccgagaaagaagccttaatagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatgaa

SEQ ID NO: 159707 - DNA, 707 bp, Homo sapiens
  Payload ID: 11255
  Gene Symbol: NLRP2
  Gene Name: NLR family, pyrin domain containing 2
  ENST ID: ENST00000543277
  CDS Start-End: 1-267
ggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacagcagctgtgctttcgatctggggccacagacgagcaatggtcatgcctgacttggctgtatggaacctctcgctgatgtgaacacctgttcccatgtttagatccaggccgatggcctgtgaattttgttcttctctcattcctattccttcataggatcaccagtgcatgatagaaggttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtgg

SEQ ID NO: 159708 - DNA, 592 bp, Homo sapiens
  Payload ID: 11255
  Gene Symbol: NLRP2
  Gene Name: NLR family, pyrin domain containing 2
  ENST ID: ENST00000588107
  CDS Start-End: 220-592
agcaatgtagcaggaccagccacagacaaaactcctcagacaccgagttaaagaagaaaggggtttatccggccaggggcatcggcaagactcccgtctcaagagccgagatccccaagtgagcaattcctgtcccttttaagggctcacaactctaagggggtgtgcgtgagagggtcgtgatcgactgagcaagcaggggctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctgg

SEQ ID NO: 159709 - DNA, 593 bp, Homo sapiens
  Payload ID: 11255
  Gene Symbol: NLRP2
  Gene Name: NLR family, pyrin domain containing 2
  ENST ID: ENST00000588619
  CDS Start-End: 174-593
aagatacaggtcataaggaccttgctgataacacaggtagcaatgtagcaggaccagccacagacaaaactcctcagacaccgagttaaagaagaaaggggtttatccggccaggggcatcggcaagactcccgtctcaagagccgagatccccaactcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaat

SEQ ID NO: 159710 - DNA, 665 bp, Homo sapiens
  Payload ID: 11255
  Gene Symbol: NLRP2
  Gene Name: NLR family, pyrin domain containing 2
  ENST ID: ENST00000540005
  CDS Start-End: 1-592
ttcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggtatatctcttaatcattaaaatccttcatcatacaaacataagctaccacaagcttatgtggcaattttgtgtaaataagaaaaa

SEQ ID NO: 159711 - DNA, 576 bp, Homo sapiens
  Payload ID: 11255
  Gene Symbol: NLRP2
  Gene Name: NLR family, pyrin domain containing 2
  ENST ID: ENST00000585500
  CDS Start-End: 171-576
aatcacagggctgcggccgagagagaagccttattagagctttctcaacctgcagccctcatctccgccggcgagtagggccaggtgttgggaggtgagaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggccct

SEQ ID NO: 159712 - DNA, 405 bp, Homo sapiens
  Payload ID: 11255
  Gene Symbol: NLRP2
  Gene Name: NLR family, pyrin domain containing 2
  ENST ID: ENST00000381637
  CDS Start-End: 1-28
agaatgtaacctgcgatatctcggctgattcctgggcgatgttggtgccactggtctgaccaccctttgacaactgctgctccagataattcaagtcggggtataacacaaccagtgagatgtaaaccaaagacgattccacggttagattctcaagaatgacttgttctgccgggcgcggtggctcacgcctgtcatcccagcactctgggaggccgaggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgtaagtctctcctc

SEQ ID NO: 159713 - DNA, 3507 bp, Homo sapiens; identical to SEQ ID NO: 159702
  Payload ID: 11255
  Gene Symbol: NLRP2
  Gene Name: NLR family, pyrin domain containing 2
  Uniprot ID: Q9NX02
  ENST ID: ENST00000622864
  CDS Start-End: 143-3265

SEQ ID NO: 159714 - DNA, 2703 bp, Homo sapiens
  Payload ID: 11255
  Gene Symbol: NLRP2
  Gene Name: NLR family, pyrin domain containing 2
  ENST ID: ENST00000616079
  CDS Start-End: 67-2703
caacctgcagccctcatctccgccggcgagtagggccaggtgttgggagctcccacgtgggacaagatggtgtcttcggcacagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagatgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacgcctgggacattggggacgtacagaagctgctttccggagtagaaagactcaggaaccccgacctgatccaagcaggctactactccttcggcctcgctaacgagaagagagccaaggagttggaggccacttttggctgccggatgtcaccggacatcaaacaggaattgctgcgatgcgacataagttgtaagggtggacattcaacggtgacagacctgcaggagctgctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtg

SEQ ID NO: 159715 - DNA, 3507 bp, Homo sapiens
  Payload ID: 11255
  Gene Symbol: NLRP2
  Gene Name: NLR family, pyrin domain containing 2
  ENST ID: ENST00000618011
  CDS Start-End: 143-3265
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcacagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagatgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacgcctgggacattggggacgtacagaagctgctttccggagtagaaagactcaggaaccccgacctgatccaagcaggctactactccttcggcctcgctaacgagaagagagccaaggagttggaggccacttttggctgccggatgtcaccggacatcaaacaggaattgctgcgatgcgacataagttgtaagggtggacattcaacggtgacagacctgcaggagctgctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 159716 - DNA, 3573 bp, Homo sapiens; identical to SEQ ID NO: 159701
  Payload ID: 11255
  Gene Symbol: NLRP2
  Gene Name: NLR family, pyrin domain containing 2
  Uniprot ID: Q9NX02
  ENST ID: ENST00000619281
  CDS Start-End: 143-3331

SEQ ID NO: 159717 - DNA, 3504 bp, Homo sapiens
  Payload ID: 11255
  Gene Symbol: NLRP2
  Gene Name: NLR family, pyrin domain containing 2
  Uniprot ID: Q9NX02
  ENST ID: ENST00000618789
  CDS Start-End: 143-3262
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 159718 - DNA, 3573 bp, Homo sapiens; identical to SEQ ID NO: 159701
  Payload ID: 11255
  Gene Symbol: NLRP2
  Gene Name: NLR family, pyrin domain containing 2
  ENST ID: ENST00000621594
  CDS Start-End: 143-3331

SEQ ID NO: 159719 - DNA, 540 bp, Homo sapiens; identical to SEQ ID NO: 159705
  Payload ID: 11255
  Gene Symbol: NLRP2
  Gene Name: NLR family, pyrin domain containing 2
  ENST ID: ENST00000618465
  CDS Start-End: 78-540

SEQ ID NO: 159720 - DNA, 3573 bp, Homo sapiens; identical to SEQ ID NO: 159701
  Payload ID: 11255
  Gene Symbol: NLRP2
  Gene Name: NLR family, pyrin domain containing 2
  Uniprot ID: Q9NX02
  ENST ID: ENST00000619664
  CDS Start-End: 143-3331

SEQ ID NO: 159721 - DNA, 3507 bp, Homo sapiens; identical to SEQ ID NO: 159702
  Payload ID: 11255
  Gene Symbol: NLRP2
  Gene Name: NLR family, pyrin domain containing 2
  Uniprot ID: Q9NX02
  ENST ID: ENST00000618731
  CDS Start-End: 143-3265

SEQ ID NO: 159722 - DNA, 3542 bp, Homo sapiens
  Payload ID: 11255
  Gene Symbol: NLRP2
  Gene Name: NLR family, pyrin domain containing 2
  Uniprot ID: Q9NX02
  ENST ID: ENST00000616040
  CDS Start-End: 112-3300
aatcacagggctgcggccgagaaagaagccttaatagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 159723 - DNA, 3573 bp, Homo sapiens; identical to SEQ ID NO: 159701
  Payload ID: 11255
  Gene Symbol: NLRP2
  Gene Name: NLR family, pyrin domain containing 2
  ENST ID: ENST00000611772
  CDS Start-End: 143-3331

SEQ ID NO: 159724 - DNA, 3504 bp, Homo sapiens
  Payload ID: 11255
  Gene Symbol: NLRP2
  Gene Name: NLR family, pyrin domain containing 2
  ENST ID: ENST00000610346
  CDS Start-End: 143-3262
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcacagatgggcttcaacctgcaggctctcctggagcagctcagccaggatgagttgagcaagttcaagtatctgatcacgaccttctccctggcacacgagctccagaagatcccccacaaggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagatgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacgcctgggacattggggacgtacagaagctgctttccggagtagaaagactcaggaaccccgacctgatccaagcaggctactactccttcggcctcgctaacgagaagagagccaaggagttggaggccacttttggctgccggatgtcaccggacatcaaacaggaattgctgcgatgcgacataagttgtaagggtggacattcaacggtgacagacctgcaggagctgctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 159725 - DNA, 3542 bp, Homo sapiens; identical to SEQ ID NO: 159722
  Payload ID: 11255
  Gene Symbol: NLRP2
  Gene Name: NLR family, pyrin domain containing 2
  ENST ID: ENST00000611410
  CDS Start-End: 112-3300

SEQ ID NO: 159726 - DNA, 3542 bp, Homo sapiens; identical to SEQ ID NO: 159722
  Payload ID: 11255
  Gene Symbol: NLRP2
  Gene Name: NLR family, pyrin domain containing 2
  ENST ID: ENST00000615521
  CDS Start-End: 112-3300

SEQ ID NO: 159727 - DNA, 3496 bp, Homo sapiens; identical to SEQ ID NO: 159697
  Payload ID: 11255
  Gene Symbol: NLRP2
  Gene Name: NLR family, pyrin domain containing 2
  ENST ID: ENST00000612740
  CDS Start-End: 80-3259

SEQ ID NO: 159728 - DNA, 3573 bp, Homo sapiens; identical to SEQ ID NO: 159701
  Payload ID: 11255
  Gene Symbol: NLRP2
  Gene Name: NLR family, pyrin domain containing 2
  ENST ID: ENST00000621239
  CDS Start-End: 143-3331

SEQ ID NO: 159729 - DNA, 3542 bp, Homo sapiens; identical to SEQ ID NO: 159722
  Payload ID: 11255
  Gene Symbol: NLRP2
  Gene Name: NLR family, pyrin domain containing 2
  ENST ID: ENST00000621200
  CDS Start-End: 112-3300

SEQ ID NO: 159730 - DNA, 2852 bp, Homo sapiens
  Payload ID: 11255
  Gene Symbol: NLRP2
  Gene Name: NLR family, pyrin domain containing 2
  ENST ID: ENST00000615023
  CDS Start-End: 144-2852
aagtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcacagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagatgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacgcctgggacattggggacgtacagaagctgctttccggagtagaaagactcaggaaccccgacctgatccaagcaggctactactccttcggcctcgctaacgagaagagagccaaggagttggaggccacttttggctgccggatgtcaccggacatcaaacaggaattgctgcgatgcgacataagttgtaagggtggacattcaacggtgacagacctgcaggagctgctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtg

SEQ ID NO: 159731 - DNA, 550 bp, Homo sapiens; identical to SEQ ID NO: 159703
  Payload ID: 11255
  Gene Symbol: NLRP2
  Gene Name: NLR family, pyrin domain containing 2
  ENST ID: ENST00000611888
  CDS Start-End: 56-550

SEQ ID NO: 159732 - DNA, 3507 bp, Homo sapiens; identical to SEQ ID NO: 159702
  Payload ID: 11255
  Gene Symbol: NLRP2
  Gene Name: NLR family, pyrin domain containing 2
  Uniprot ID: Q9NX02
  ENST ID: ENST00000616919
  CDS Start-End: 143-3265

SEQ ID NO: 159733 - DNA, 3573 bp, Homo sapiens; identical to SEQ ID NO: 159701
  Payload ID: 11255
  Gene Symbol: NLRP2
  Gene Name: NLR family, pyrin domain containing 2
  ENST ID: ENST00000615391
  CDS Start-End: 143-3331

SEQ ID NO: 159734 - DNA, 3507 bp, Homo sapiens; identical to SEQ ID NO: 159702
  Payload ID: 11255
  Gene Symbol: NLRP2
  Gene Name: NLR family, pyrin domain containing 2
  ENST ID: ENST00000611676
  CDS Start-End: 143-3265

SEQ ID NO: 159735 - DNA, 3507 bp, Homo sapiens; identical to SEQ ID NO: 159702
  Payload ID: 11255
  Gene Symbol: NLRP2
  Gene Name: NLR family, pyrin domain containing 2
  ENST ID: ENST00000622216
  CDS Start-End: 143-3265

SEQ ID NO: 159736 - DNA, 3504 bp, Homo sapiens; identical to SEQ ID NO: 159717
  Payload ID: 11255
  Gene Symbol: NLRP2
  Gene Name: NLR family, pyrin domain containing 2
  ENST ID: ENST00000622444
  CDS Start-End: 143-3262

SEQ ID NO: 159737 - DNA, 3542 bp, Homo sapiens; identical to SEQ ID NO: 159722
  Payload ID: 11255
  Gene Symbol: NLRP2
  Gene Name: NLR family, pyrin domain containing 2
  Uniprot ID: Q9NX02
  ENST ID: ENST00000622042
  CDS Start-End: 112-3300

SEQ ID NO: 159738 - DNA, 3504 bp, Homo sapiens; identical to SEQ ID NO: 159717
  Payload ID: 11255
  Gene Symbol: NLRP2
  Gene Name: NLR family, pyrin domain containing 2
  ENST ID: ENST00000618943
  CDS Start-End: 143-3262

SEQ ID NO: 159739 - DNA, 592 bp, Homo sapiens; identical to SEQ ID NO: 159708
  Payload ID: 11255
  Gene Symbol: NLRP2
  Gene Name: NLR family, pyrin domain containing 2
  ENST ID: ENST00000615586
  CDS Start-End: 220-592

SEQ ID NO: 159740 - DNA, 3504 bp, Homo sapiens; identical to SEQ ID NO: 159717
  Payload ID: 11255
  Gene Symbol: NLRP2
  Gene Name: NLR family, pyrin domain containing 2
  ENST ID: ENST00000616903
  CDS Start-End: 143-3262

SEQ ID NO: 159741 - DNA, 3504 bp, Homo sapiens; identical to SEQ ID NO: 159717
  Payload ID: 11255
  Gene Symbol: NLRP2
  Gene Name: NLR family, pyrin domain containing 2
  ENST ID: ENST00000618694
  CDS Start-End: 143-3262

SEQ ID NO: 159742 - DNA, 3504 bp, Homo sapiens; identical to SEQ ID NO: 159717
  Payload ID: 11255
  Gene Symbol: NLRP2
  Gene Name: NLR family, pyrin domain containing 2
  Uniprot ID: Q9NX02
  ENST ID: ENST00000613851
  CDS Start-End: 143-3262

SEQ ID NO: 159743 - DNA, 3507 bp, Homo sapiens; identical to SEQ ID NO: 159702
  Payload ID: 11255
  Gene Symbol: NLRP2
  Gene Name: NLR family, pyrin domain containing 2
  ENST ID: ENST00000622600
  CDS Start-End: 143-3265

SEQ ID NO: 159744 - DNA, 2702 bp, Homo sapiens
  Payload ID: 11255
  Gene Symbol: NLRP2
  Gene Name: NLR family, pyrin domain containing 2
  ENST ID: ENST00000615197
  CDS Start-End: 60-2702
cagccctcatctccgccggcgagtagggccaggtgttgggagctcccacgtgggacaagatggtgtcttcggcacagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagatgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacgcctgggacattggggacgtacagaagctgctttccggagtagaaagactcaggaaccccgacctgatccaagcaggctactactccttcggcctcgctaacgagaagagagccaaggagttggaggccacttttggctgccggatgtcaccggacatcaaacaggaattgctgcgatgcgacataagttgtaagggtggacattcaacggtgacagacctgcaggagctgctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtg

SEQ ID NO: 159745 - DNA, 3573 bp, Homo sapiens; identical to SEQ ID NO: 159701
  Payload ID: 11255
  Gene Symbol: NLRP2
  Gene Name: NLR family, pyrin domain containing 2
  Uniprot ID: Q9NX02
  ENST ID: ENST00000615173
  CDS Start-End: 143-3331

SEQ ID NO: 159746 - DNA, 3576 bp, Homo sapiens; identical to SEQ ID NO: 159706
  Payload ID: 11255
  Gene Symbol: NLRP2
  Gene Name: NLR family, pyrin domain containing 2
  Uniprot ID: Q9NX02
  ENST ID: ENST00000613062
  CDS Start-End: 144-3332

SEQ ID NO: 159747 - DNA, 665 bp, Homo sapiens; identical to SEQ ID NO: 159710
  Payload ID: 11255
  Gene Symbol: NLRP2
  Gene Name: NLR family, pyrin domain containing 2
  ENST ID: ENST00000617384
  CDS Start-End: 1-592

SEQ ID NO: 159748 - DNA, 3020 bp, Homo sapiens
  Payload ID: 11255
  Gene Symbol: NLRP2
  Gene Name: NLR family, pyrin domain containing 2
  ENST ID: ENST00000621165
  CDS Start-End: 111-2651
atcacagggctgcggccgagagagaagccttattagagctttctcaacctgcagccctcatctccgccggcgagtagggccaggtgttgggagctcccacgtgggacaagatggtgtcttcggcacagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagatgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacgcctgggacattggggacgtacagaagctgctttccggagtagaaagactcaggaaccccgacctgatccaagcaggctactactccttcggcctcgctaacgagaagagagccaaggagttggaggccacttttggctgccggatgtcaccggacatcaaacaggaattgctgcgatgcgacataagttgtaagggtggacattcaacggtgacagacctgcaggagctgctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgtaagtctctcctctcttccagagcagctgtgctttcgatctggggccacagacgagcaatggtcatgcctgacttggctgtatggaacctctcgctgatgtgaacacctgttcccatgtttagatccaggccgatggcctgtgaattttgttcttctctcattcctattccttcataggatcaccagtgcatgatagaaggttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtg

SEQ ID NO: 159749 - DNA, 593 bp, Homo sapiens; identical to SEQ ID NO: 159709
  Payload ID: 11255
  Gene Symbol: NLRP2
  Gene Name: NLR family, pyrin domain containing 2
  ENST ID: ENST00000621151
  CDS Start-End: 174-593

SEQ ID NO: 159750 - DNA, 3507 bp, Homo sapiens; identical to SEQ ID NO: 159702
  Payload ID: 11255
  Gene Symbol: NLRP2
  Gene Name: NLR family, pyrin domain containing 2
  ENST ID: ENST00000619885
  CDS Start-End: 143-3265

SEQ ID NO: 159751 - DNA, 3542 bp, Homo sapiens; identical to SEQ ID NO: 159722
  Payload ID: 11255
  Gene Symbol: NLRP2
  Gene Name: NLR family, pyrin domain containing 2
  ENST ID: ENST00000619454
  CDS Start-End: 112-3300

SEQ ID NO: 159752 - DNA, 577 bp, Homo sapiens; identical to SEQ ID NO: 159704
  Payload ID: 11255
  Gene Symbol: NLRP2
  Gene Name: NLR family, pyrin domain containing 2
  ENST ID: ENST00000614389
  CDS Start-End: 52-381

SEQ ID NO: 159753 - DNA, 3507 bp, Homo sapiens; identical to SEQ ID NO: 159702
  Payload ID: 11255
  Gene Symbol: NLRP2
  Gene Name: NLR family, pyrin domain containing 2
  ENST ID: ENST00000618018
  CDS Start-End: 143-3265

SEQ ID NO: 159754 - DNA, 3573 bp, Homo sapiens; identical to SEQ ID NO: 159701
  Payload ID: 11255
  Gene Symbol: NLRP2
  Gene Name: NLR family, pyrin domain containing 2
  ENST ID: ENST00000613825
  CDS Start-End: 143-3331

SEQ ID NO: 159755 - DNA, 3573 bp, Homo sapiens
  Payload ID: 11255
  Gene Symbol: NLRP2
  Gene Name: NLR family, pyrin domain containing 2
  ENST ID: ENST00000620082
  CDS Start-End: 143-3331
agtgctcagcaacgattacgccccgagggccaatcacagggctgcggccgagagagaagccttattagagctttctcaacctgcagccctcatctccgccggcgagtagggccaggtgttgggagctcccacgtgggacaagatggtgtcttcggcacagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagatgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacgcctgggacattggggacgtacagaagctgctttccggagtagaaagactcaggaaccccgacctgatccaagcaggctactactccttcggcctcgctaacgagaagagagccaaggagttggaggccacttttggctgccggatgtcaccggacatcaaacaggaattgctgcgatgcgacataagttgtaagggtggacattcaacggtgacagacctgcaggagctgctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatg

SEQ ID NO: 159756 - DNA, 3504 bp, Homo sapiens; identical to SEQ ID NO: 159717
  Payload ID: 11255
  Gene Symbol: NLRP2
  Gene Name: NLR family, pyrin domain containing 2
  ENST ID: ENST00000611642
  CDS Start-End: 143-3262

SEQ ID NO: 159757 - DNA, 3422 bp, Homo sapiens; identical to SEQ ID NO: 159698
  Payload ID: 11255
  Gene Symbol: NLRP2
  Gene Name: NLR family, pyrin domain containing 2
  Uniprot ID: Q9NX02
  ENST ID: ENST00000613485
  CDS Start-End: 60-3182

SEQ ID NO: 159758 - DNA, 3542 bp, Homo sapiens; identical to SEQ ID NO: 159722
  Payload ID: 11255
  Gene Symbol: NLRP2
  Gene Name: NLR family, pyrin domain containing 2
  ENST ID: ENST00000611679
  CDS Start-End: 112-3300

SEQ ID NO: 159759 - DNA, 3420 bp, Homo sapiens; identical to SEQ ID NO: 159699
  Payload ID: 11255
  Gene Symbol: NLRP2
  Gene Name: NLR family, pyrin domain containing 2
  Uniprot ID: Q9NX02
  ENST ID: ENST00000621057
  CDS Start-End: 67-3183

SEQ ID NO: 159760 - DNA, 405 bp, Homo sapiens; identical to SEQ ID NO: 159712
  Payload ID: 11255
  Gene Symbol: NLRP2
  Gene Name: NLR family, pyrin domain containing 2
  ENST ID: ENST00000610410
  CDS Start-End: 1-28

SEQ ID NO: 159761 - DNA, 3411 bp, Homo sapiens; identical to SEQ ID NO: 159700
  Payload ID: 11255
  Gene Symbol: NLRP2
  Gene Name: NLR family, pyrin domain containing 2
  Uniprot ID: Q9NX02
  ENST ID: ENST00000622773
  CDS Start-End: 112-3231

SEQ ID NO: 159762 - DNA, 576 bp, Homo sapiens; identical to SEQ ID NO: 159711
  Payload ID: 11255
  Gene Symbol: NLRP2
  Gene Name: NLR family, pyrin domain containing 2
  ENST ID: ENST00000611476
  CDS Start-End: 171-576

SEQ ID NO: 159763 - DNA, 707 bp, Homo sapiens; identical to SEQ ID NO: 159707
  Payload ID: 11255
  Gene Symbol: NLRP2
  Gene Name: NLR family, pyrin domain containing 2
  ENST ID: ENST00000617992
  CDS Start-End: 1-267

SEQ ID NO: 159764 - DNA, 3194 bp, Homo sapiens
  Payload ID: 11256
  Gene Symbol: NLRP2P
  Gene Name: NLR family, pyrin domain containing 2 pseudogene
  Uniprot ID: P0DMW2
  ENST ID: ENST00000434992
  CDS Start-End: 1-138
atggtgtcttctgcacagctggacttcaacctgcaggctcttctgggacagctcagccaggatgacttgtgcaagttcaagtctctgatcaggaccgtctccctgggaaatgagctgcaaaagatcccccagacataggtagacaaggctgatgggaagcaactggcagaaatcatcaccagccattgccacagctactggatgaagatagagaccatccaggtctttgaaaagatgcaccgagcggatctgtctgagaaagtaaaggatgaactcagagaagacactttgaaatcaagcctgtatcattagggaaaacagggaaagaagagccaaaacctatagacctgaaacaaatgctggggcgtttcgaagcagaagcactagagtttatagaaacggaggaagatgtcaccagcctaagagaagctaaagaagtcttgaaaggagaaaagccaggtaaagaggataggtacaggagtatattgaagacgaagttctggcaaatgtggaaaacctggcctggagacctcaaagtggtccatattatggctcagagatacaagatgctgatcccgttcagcaaccccagggtgcttcccgggccctgcccacacacggtggtgctgcatggtcctgcgggccttgggaaaaccacgctggccaagaaattaatgctggactgggcagaggacaacctcagccagaaatttagataggctttctacctcacctgcaaggagctcatctgcctgggcccgtgcagttttgcagagctggtcttcaggaactggcctgaattgcaggatgacattccaaacatcctagcccaagcacagaaaatcctgttcgtggtcgacggctttgatgagctgggagccccacctggggcactgatctaggacatctgtggggactgggagaagcagaagccggtgccggtcttcttggggaggttactgaagaggaagattttacccagggccgccgtgctggtcaccacgtggcctgcgggccctgagagacctccggctgttggtggagcggccgatctatgtaagggtggaggagttcctggagaaggacaggagggcatatttcctgagacactttggagacgaggaccaagccatgtgtgcctttgagctgatgagaagaaacgcggccctgttccagcctgtctcggcacccatggtgtgctggatcatgtgcatgagtctgaagctgcagaggttagaaggggaaggacccgccccacccgcacggggctgttcctgcgcttcctttgcggccggttcccgcagggcgcacagctctggggcgtgctgcgggcgctgagcctcctggcggcacagggcctgtgggcgcagatgtcagtgttccgtggagaggacttggcgaggctcggggtgcaggagttcaacatccgcccgtccctggacagagacatcctccgccaggacatagtctctaaaggctgctattcctacatccacctcagcttccagcagtttttcactgtgctgttccacgccctggagaaggaggaggaggaggaggaggaggacaaggacggccacgcctgggacaatggagacgtgcagaagctgttttctagagaagaaagactcaagaaccccgacctgatccaagcaagacacttcttattcggcttcgccaacgagaagaaagccaaggagttggagaccactttgggctgcctgatgtcaccggagatcaaaaaggaattactgtgatgagagataaattgtgaaaaggttggacactcaacaatgatgaacccgaaggagctcttgtgctgtctgtacgagtctcaggaggaggagctggtgaagggagtgatggctccgttcaaagaaatatccctgcacttaaatgcagtagacattatgctgttttcaatctgcctcaagcattgtcgaaacttgcagaaaatgccactgcaggcagcaaaggcaaagctcccagagaatgtcactgtgtctgaatcagatgctgaagttgagagatcccaggatgatcaacacatgcttcctttctggaccgacctttgttccatatttggctcaaataaggatctgatcattctagaaatcaataatagctttcttggtgccacattagtaaggatcctgtgtgaacaaatagcttctgacacctgtcgtctccagagagtgatgttcaaaaacatttcaccagctgatgcttatcggaacctctgcctagctctttgaggtcacaagactgtaagatatctgacccttcaaggcaatgaccagaatgatatgcttcctgcattgtgtaaggtcttgagacactcaaaatgtaacctgcaatatctcgggttggtgtctttttccaccaccacttagcaatgggctgatctctccttggcccttgaagtcaaccagtccctgacatgtgtaaacctctctcacaatgagctcttggatgagggtgccaagttgctgtacacaactttgagacacccaaaatgcttcctgccgaggttgttgttggaaaactgtcactttatagaaggcaattgcaagaactttgctgctgttttggttgtcagcggggagctgacacacctgtgcttggccaagaaccccccactcggggatacatgggtgatgtttctgtgtaagggtttgagttacccccattgtaaactacagaccctggtgctgtgggactgcgacataactagcaatggctgctgttatctcgcagagcttctccaagaaaaatcaagcctaatgtgcttggatctgggactgaatcacataggagttactggagtgaagctcctatgtgaggctttgaagaaaccactgtgtaacttgagatgtctgtggttgtgggggtgttccatccctctgttcagttgtgaggacctctgctctgtgctcagctgcaaccacagcctcgtcgttctggacctgagccagaatcccttggggtctagtggagtaaagatgctgtttgaaaccttgacacatccaaattgcaccctccagacactcaggttgaaaatagatgactttaatgttgaactcgataagctgctggaagaaatagaagaaaacaacccacaactgcctgctgataactgagaaacatgatcctttgggggggaaaaaaggctttcttttcattacttcattatc

SEQ ID NO: 159765 - DNA, 3828 bp, Homo sapiens
  Payload ID: 11257
  Gene Symbol: NLRP3
  Gene Name: NLR family, pyrin domain containing 3
  Uniprot ID: Q96P20
  ENST ID: ENST00000348069
  CDS Start-End: 747-3515
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttt

SEQ ID NO: 159766 - DNA, 4170 bp, Homo sapiens
  Payload ID: 11257
  Gene Symbol: NLRP3
  Gene Name: NLR family, pyrin domain containing 3
  Uniprot ID: Q96P20
  ENST ID: ENST00000336119
  CDS Start-End: 747-3857
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttt

SEQ ID NO: 159767 - DNA, 3996 bp, Homo sapiens
  Payload ID: 11257
  Gene Symbol: NLRP3
  Gene Name: NLR family, pyrin domain containing 3
  Uniprot ID: Q96P20
  ENST ID: ENST00000366496
  CDS Start-End: 744-3683
gatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttt

SEQ ID NO: 159768 - DNA, 4318 bp, Homo sapiens
  Payload ID: 11257
  Gene Symbol: NLRP3
  Gene Name: NLR family, pyrin domain containing 3
  Uniprot ID: Q96P20
  ENST ID: ENST00000366497
  CDS Start-End: 781-3720
gcatttcctctctagctgttcctgaggctggcatctggatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaatttt

SEQ ID NO: 159769 - DNA, 2940 bp, Homo sapiens
  Payload ID: 11257
  Gene Symbol: NLRP3
  Gene Name: NLR family, pyrin domain containing 3
  Uniprot ID: Q96P20
  ENST ID: ENST00000391827
  CDS Start-End: 1-2940
atgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtag

SEQ ID NO: 159770 - DNA, 3853 bp, Homo sapiens
  Payload ID: 11257
  Gene Symbol: NLRP3
  Gene Name: NLR family, pyrin domain containing 3
  Uniprot ID: Q96P20
  ENST ID: ENST00000391828
  CDS Start-End: 139-3249
gcatttcctctctagctgttcctgaggctggcatctggggaaacctttcttccatggctcaggacacactcctggatcgagccaacaggagaactttctgtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaaaaaa

SEQ ID NO: 159771 - DNA, 3670 bp, Homo sapiens
  Payload ID: 11258
  Gene Symbol: NLRP4
  Gene Name: NLR family, pyrin domain containing 4
  Uniprot ID: Q96MN2
  ENST ID: ENST00000301295
  CDS Start-End: 423-3407
gtgctgggctgttcgtctcttctatgtgctgatttcctgggttactttgggtcttccttttctttctcccttttaccctgtctcctttcttgaggctgatcgatcacagccaggcctctccattctatttacccagcgttttccttctctccagttagtggggtagatgaacgccctgtgtttataaggtgcctcccaggagcctgagacctgtgagaagaatggggggtggaggtgggggagactcgtcacgaagggagaccttggagcttcgagggtgggaatgttcttattagattcttcatctctgttgacacaaacatgtaggagaagctggagaacatagacagggatgaggttttatttatttattgttcctggtcactgtctctttgaggattggtatctctgctccagaaaagatggcagcctctttcttctctgattttggtcttatgtggtatctggaggagctcaaaaaggaggagttcaggaaatttaaagaacatctcaagcaaatgactttgcagcttgaactcaagcagattccctggactgaggtcaaaaaagcatcccgggaagaacttgcaaacctcttgatcaagcactatgaagaacaacaagcttggaacataaccttaagaatctttcaaaagatggatagaaaggatctctgcatgaaggtcatgagggagagaacaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaagctgggaaacagccacgtacagtgatcattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggcctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgctatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgctggtaaattgtcacctctcacccattgattgtgaagtccttgctggccttctaaccaacaacaagaagctgacgtatctgaatgtatcctgcaaccagttagacacaggcgtgccccttttgtgtgaagccctgtgcagcccagacacggtcctggtatacctgatgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtgtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgatactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacatt

SEQ ID NO: 159772 - DNA, 3201 bp, Homo sapiens
  Payload ID: 11258
  Gene Symbol: NLRP4
  Gene Name: NLR family, pyrin domain containing 4
  Uniprot ID: Q96MN2
  ENST ID: ENST00000587891
  CDS Start-End: 175-2934
agctgttcagctctgctattcaatcaggaaggctcctgtagacaatatacccgtgaatggtgtagtgagttctaatgaaactttatttacaagaggagactgaccaggtttggcctgggggccacagtgtgtagacccctggaaagatacatcctgagaagaaaaaaagaatatatgcaggaatgcttaactttgtgggttttctctcctcttgccctcactgactcaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaagctgggaaacagccacgtacagtgatcattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggcctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgctatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgctggtaaattgtcacctctcacccattgattgtgaagtccttgctggccttctaaccaacaacaagaagctgacgtatctgaatgtatcctgcaaccagttagacacaggcgtgccccttttgtgtgaagccctgtgcagcccagacacggtcctggtatacctgatgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtgtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgatactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacattggaa

SEQ ID NO: 159773 - DNA, 572 bp, Homo sapiens
  Payload ID: 11258
  Gene Symbol: NLRP4
  Gene Name: NLR family, pyrin domain containing 4
  ENST ID: ENST00000587464
  CDS Start-End: 106-572
aaacatgtaggagaagctggagaacatagacagggatgaggttttatttatttattgttcctggtcactgtctctttgaggattggtatctctgctccagaaaagatggcagcctctttcttctctgattttggtcttatgtggtatctggaggagctcaaaaaggaggagttcaggaaatttaaagaacatctcaagcaaatgactttgcagcttgaactcaagcagattccctggactgaggtcaaaaaagcatcccgggaagaacttgcaaacctcttgatcaagcactatgaagaacaacaagcttggaacataaccttaagaatctttcaaaagatggatagaaaggatctctgcatgaaggtcatgagggagagaacaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaagctgggaaacagccacgtacagtgatcattcaaggacc

SEQ ID NO: 159774 - DNA, 1781 bp, Homo sapiens
  Payload ID: 11258
  Gene Symbol: NLRP4
  Gene Name: NLR family, pyrin domain containing 4
  ENST ID: ENST00000589437
  CDS Start-End: 1-1514
ccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtgtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagacgactgtgacacaatcacaagggtagagatctgattgcgaggaacctgggctctgactcgaacacctgcaaaggacagggactgggaccgttacttacatgacactgcacccaggagatacaaatcattgatactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttctaaacattggaa

SEQ ID NO: 159775 - DNA, 3888 bp, Homo sapiens
  Payload ID: 11259
  Gene Symbol: NLRP5
  Gene Name: NLR family, pyrin domain containing 5
  Uniprot ID: P59047
  ENST ID: ENST00000390649
  CDS Start-End: 1-3603
atgaaggttgcaggaggacttgaacttggagctgctgctctgctctcagcatcaccacgtgctcttgtcactctttccacaggtcctacttgctctatattaccaaagaatccacttttcccccaaaacctgagctctcagccttgtatcaagatggaaggagacaaatcgctcaccttttccagctacgggctgcaatggtgtctctatgagctagacaaggaagaatttcagacattcaaggaattactaaagaagaaatcttcagaatcgaccacatgctctattccacagtttgaaatcgagaatgccaacgtggaatgtctggcactcctcttgcatgagtattatggagcatcgctggcctgggctacgtccattagcatctttgaaaacatgaacctgcgaaccctctcggagaaggcacgggatgacatgaaaagacattcaccagaagatcctgaagcaacgatgactgaccaaggaccaagcaaggaaaaagtgccaggaatttcacaagctgtgcaacaagatagtgccacagctgcagagacaaaagaacaagaaatttcacaagctatggaacaagaaggtgccacagcagcagagacagaagaacaagaaatttcacaagctatggaacaagaaggtgccacagcagcagagacagaagaacaaggacatggaggtgacacatgggactacaagagtcacgtgatgaccaaattcgctgaggaggaggatgtacgtcgtagttttgaaaacactgctgctgactggccggaaatgcaaacgttggctggtgcttttgattcagaccggtggggcttccggcctcgcacggtggttctgcacggaaagtcaggaattgggaaatcggctctagccagaaggatcgtgctgtgctgggcgcaaggtggactctaccagggaatgttctcctacgtcttcttcctccccgttagagagatgcagcggaagaaggagagcagtgtcacagagttcatctccagggagtggccagactcccaggctccggtgacggagatcatgtcccgaccagaaaggctgttgttcatcattgacggtttcgatgacctgggctctgtcctcaacaatgacacaaagctctgcaaagactgggctgagaagcagcctccgttcaccctcatacgcagtctgctgaggaaggtcctgctccctgagtccttcctgatcgtcaccgtcagagacgtgggcacagagaagctcaagtcagaggtcgtgtctccccgttacctgttagttagaggaatctccggggaacaaagaatccacttgctccttgagcgcgggattggtgagcatcagaagacacaagggttgcgtgcgatcatgaacaaccgtgagctgctcgaccagtgccaggtgcccgccgtgggctctctcatctgcgtggccctgcagctgcaggacgtggtgggggagagcgtcgcccccttcaaccaaacgctcacaggcctgcacgccgcttttgtgtttcatcagctcacccctcgaggcgtggtccggcgctgtctcaatctggaggaaagagttgtcctgaagcgcttctgccgtatggctgtggagggagtgtggaataggaagtcagtgtttgacggtgacgacctcatggttcaaggactcggggagtctgagctccgtgctctgtttcacatgaacatccttctcccagacagccactgtgaggagtactacaccttcttccacctcagtctccaggacttctgtgccgccttgtactacgtgttagagggcctggaaatcgagccagctctctgccctctgtacgttgagaagacaaagaggtccatggagcttaaacaggcaggcttccatatccactcgctttggatgaagcgtttcttgtttggcctcgtgagcgaagacgtaaggaggccactggaggtcctgctgggctgtcccgttcccctgggggtgaagcagaagcttctgcactgggtctctctgttgggtcagcagcctaatgccaccaccccaggagacaccctggacgccttccactgtcttttcgagactcaagacaaagagtttgttcgcttggcattaaacagcttccaagaagtgtggcttccgattaaccagaacctggacttgatagcatcttccttctgcctccagcactgtccgtatttgcggaaaattcgggtggatgtcaaagggatcttcccaagagatgagtccgctgaggcatgtcctgtggtccctctatggatgcgggataagaccctcattgaggagcagtgggaagatttctgctccatgcttggcacccacccacacctgcggcagctggacctgggcagcagcatcctgacagagcgggccatgaagaccctgtgtgccaagctgaggcatcccacctgcaagatacagaccctgatgtttagaaatgcacagattacccctggtgtgcagcacctctggagaatcgtcatggccaaccgtaacctaagatccctcaacttgggaggcacccacctgaaggaagaggatgtaaggatggcgtgtgaagccttaaaacacccaaaatgtttgttggagtctttgaggctggattgctgtggattgacccatgcctgttacctgaagatctcccaaatccttacgacctcccccagcctgaaatctctgagcctggcaggaaacaaggtgacagaccagggagtaatgcctctcagtgatgccttgagagtctcccagtgcgccctgcagaagctgatactggaggactgtggcatcacagccacgggttgccagagtctggcctcagccctcgtcagcaaccggagcttgacacacctgtgcctatccaacaacagcctggggaacgaaggtgtaaatctactgtgtcgatccatgaggcttccccactgtagtctgcagaggctgatgctgaatcagtgccacctggacacggctggctgtggttttcttgcacttgcgcttatgggtaactcatggctgacgcacctgagccttagcatgaaccctgtggaagacaatggcgtgaagcttctgtgcgaggtcatgagagaaccatcttgtcatctccaggacctggagttggtaaagtgtcatctcaccgccgcgtgctgtgagagtctgtcctgtgtgatctcgaggagcagacacctgaagagcctggatctcacggacaatgccctgggtgacggtggggttgctgcgctgtgcgagggactgaagcaaaagaacagtgttctggcgagactcgggttgaaggcatgtggactgacttctgattgctgtgaggcactctccttggccctttcctgcaaccggcatctgaccagtctaaacctggtgcagaataacttcagtcccaaaggaatgatgaagctgtgttcggcctttgcctgtcccacgtctaacttacagataattgggctgtggaaatggcagtaccctgtgcaaataaggaagctgctggaggaagtgcagctactcaagccccgagtcgtaattgacggtagttggcattcttttgatgaagatgaccggtactggtggaaaaactgaagatacggaaacctgccccactcacacccatctgatggaggaactttaaacgctgttttctcagagcaagctatgcacctgggagttccttctcaaagatggagaatgatttctgattctcacaaagccctcaatggtagtgattcttctgtgttcactctacgttggttactggatttgaaggctagagaccttcaagtcataggactcagtatctgtgaaatgtccgtcatatctcagagcatatagagggaattaaataaacacaaagcatttggaaaagtt

SEQ ID NO: 159776 - DNA, 668 bp, Homo sapiens
  Payload ID: 11259
  Gene Symbol: NLRP5
  Gene Name: NLR family, pyrin domain containing 5
  ENST ID: ENST00000597673
  CDS Start-End: 1-537
ggtcctacttgctctatattaccaaagaatccacttttcccccaaaacctgagctctcagccttgtatcaagatggaaggagacaaatcgctcaccttttccagctacgggctgcaatggtgtctctatgagctagacaaggaagaatttcagacattcaaggaattactaaagaagaaatcttcagaatcgaccacatgctctattccacagtttgaaatcgagaatgccaacgtggaatgtctggcactcctcttgcatgagtattatggagcatcgctggcctgggctacgtccattagcatctttgaaaacatgaacctgcgaaccctctcggagaaggcacgggatgacatgaaaagacattcaccagaagatcctgaagcaacgatgactgaccaaggaccaagcaaggaaaaagtgccaggaatttcacaagctgtgcaacaagatagtgccacagctgcagagacaaaagaacaagagagttttgctgtattgctgagactacaatgcagtggctatccacaagcatgaccgtagctcactacagcctcaaactgctggactcaagtgattctcctgcctcagcctcccaagtagctgggactacaggcataaatttcacaagctatggaacaagaaggtgccacagcagcagagacaga

SEQ ID NO: 159777 - DNA, 3885 bp, Homo sapiens
  Payload ID: 11259
  Gene Symbol: NLRP5
  Gene Name: NLR family, pyrin domain containing 5
  ENST ID: ENST00000621651
  CDS Start-End: 1-3603
atgaaggttgcaggaggacttgaacttggagctgctgctctgctctcagcatcaccacgtgctcttgtcactctttccacaggtcctacttgctctatattaccaaagaatccacttttcccccaaaacctgagctctcagccttgtatcaagatggaaggagacaaatcgctcaccttttccagctacgggctgcaatggtgtctctatgagctagacaaggaagaatttcagacattcaaggaattactaaagaagaaatcttcagaatcgaccacatgctctattccacagtttgaaatcgagaatgccaacgtggaatgtctggcactcctcttgcatgagtattatggagcatcgctggcctgggctacgtccattagcatctttgaaaacatgaacctgcgaaccctctcggagaaggcacgggatgacatgaaaagacattcaccagaagatcctgaagcaacgatgactgaccaaggaccaagcaaggaaaaagtgccagacatctctgactcaaataataaacacaagtatgttggaattcattcttcttttgcagaaatttcacaagctatggaacaagaaggtgccacagcagcagagacagaagaacaagaaatttcacaagctatggaacaagaaggtgccacagcagcagagacagaagaacaaggacatggaggtgacacatgggactacaagagtcacgtgatgaccaaattcgctgaggaggaggatgtacgtcgtagttttgaaaacactgctgctgactggccggaaatgcaaacgttggctggtgcttttgattcagaccggtggggcttccggcctcgcacggtggttctgcacggaaagtcaggaattgggaaatcggctctagccagaaggatcgtgctgtgctgggcgcaaggtggactctaccagggaatgttctcctacgtcttcttcctccccgttagagagatgcagcggaagaaggagagcagtgtcacagagttcatctccagggagtggccagactcccaggctccggtgacggagatcatgtcccgaccagaaaggctgttgttcatcattgacggtttcgatgacctgggctctgtcctcaacaatgacacaaagctctgcaaagactgggctgagaagcagcctccgttcaccctcatacgcagtctgctgaggaaggtcctgctccctgagtccttcctgatcgtcaccgtcagagacgtgggcacagagaagctcaagtcagaggtcgtgtctccccgttacctgttagttagaggaatctccggggaacaaagaatccacttgctccttgagcgcgggattggtgagcatcagaagacacaagggttgcgtgcgatcatgaacaaccgtgagctgctcgaccagtgccaggtgcccgccgtgggctctctcatctgcgtggccctgcagctgcaggacgtggtgggggagagcgtcgcccccttcaaccaaacgctcacaggcctgcacgccgcttttgtgtttcatcagctcacccctcgaggcgtggtccggcgctgtctcaatctggaggaaagagttgtcctgaagcgcttctgccgtatggctgtggagggagtgtggaataggaagtcagtgtttgacggtgacgacctcatggttcaaggactcggggagtctgagctccgtgctctgtttcacatgaacatccttctcccagacagccactgtgaggagtactacaccttcttccacctcagtctccaggacttctgtgccgccttgtactacgtgttagagggcctggaaatcgagccagctctctgccctctgtacgttgagaagacaaagaggtccatggagcttaaacaggcaggcttccatatccactcgctttggatgaagcgtttcttgtttggcctcgtgagcgaagacgtaaggaggccactggaggtcctgctgggctgtcccgttcccctgggggtgaagcagaagcttctgcactgggtctctctgttgggtcagcagcctaatgccaccaccccaggagacaccctggacgccttccactgtcttttcgagactcaagacaaagagtttgttcgcttggcattaaacagcttccaagaagtgtggcttccgattaaccagaacctggacttgatagcatcttccttctgcctccagcactgtccgtatttgcggaaaattcgggtggatgtcaaagggatcttcccaagagatgagtccgctgaggcatgtcctgtggtccctctatggatgcgggataagaccctcattgaggagcagtgggaagatttctgctccatgcttggcacccacccacacctgcggcagctggacctgggcagcagcatcctgacagagcgggccatgaagaccctgtgtgccaagctgaggcatcccacctgcaagatacagaccctgatgtttagaaatgcacagattacccctggtgtgcagcacctctggagaatcgtcatggccaaccgtaacctaagatccctcaacttgggaggcacccacctgaaggaagaggatgtaaggatggcgtgtgaagccttaaaacacccaaaatgtttgttggagtctttgaggctggattgctgtggattgacccatgcctgttacctgaagatctcccaaatccttacgacctcccccagcctgaaatctctgagcctggcaggaaacaaggtgacagaccagggagtaatgcctctcagtgatgccttgagagtctcccagtgcgccctgcagaagctgatactggaggactgtggcatcacagccacgggttgccagagtctggcctcagccctcgtcagcaaccggagcttgacacacctgtgcctatccaacaacagcctggggaacgaaggtgtaaatctactgtgtcgatccatgaggcttccccactgtagtctgcagaggctgatgctgaatcagtgccacctggacacggctggctgtggttttcttgcacttgcgcttatgggtaactcatggctgacgcacctgagccttagcatgaaccctgtggaagacaatggcgtgaagcttctgtgcgaggtcatgagagaaccatcttgtcatctccaggacctggagttggtaaagtgtcatctcaccgccgcgtgctgtgagagtctgtcctgtgtgatctcgaggagcagacacctgaagagcctggatctcacggacaatgccctgggtgacggtggggttgctgcgctgtgcgagggactgaagcaaaagaacagtgttctggcgagactcgggttgaaggcatgtggactgacttctgattgctgtgaggcactctccttggccctttcctgcaaccggcatctgaccagtctaaacctggtgcagaataacttcagtcccaaaggaatgatgaagctgtgttcggcctttgcctgtcccacgtctaacttacagataattgggctgtggaaatggcagtaccctgtgcaaataaggaagctgctggaggaagtgcagctactcaagccccgagtcgtaattgacggtagttggcattcttttgatgaagatgaccggtactggtggaaaaactgaagatacggaaacctgccccactcacacccatctgatggaggaactttaaacgctgttttctcagagcaagctatgcacctgggagttccttctcaaagatggagaatgatttctgattctcacaaagccctcaatggtagtgattcttctgtgttcactctacgttggttactggatttgaaggctagagaccttcaagtcataggactcagtatctgtgaaatgtccgtcatatctcagagcatatagagggaattaaataaacacaaagcatttggaaaa

SEQ ID NO: 159778 - DNA, 2679 bp, Homo sapiens
  Payload ID: 11260
  Gene Symbol: NLRP6
  Gene Name: NLR family, pyrin domain containing 6
  Uniprot ID: P59044
  ENST ID: ENST00000312165
  CDS Start-End: 1-2679
atggaccagccagaggccccctgctccagcacggggccgcgcctcgcggtggcccgcgagctgctcctggctgcgctggaggaactgagccaagagcagctgaagcgcttccgccacaagctgcgcgacgtgggcccggacggacgcagcatcccgtgggggcggctggagcgcgcggacgccgtggacctcgcggagcagctggcccagttctacggcccggagcctgccctggaggtggcccgcaagaccctcaagagggcggacgcgcgcgacgtggcggcgcagctccaggagcggcggctgcagcggctcgggctcggctccgggacgctgctctccgtgtccgagtacaagaagaagtaccgggagcacgtgctgcagctgcacgctcgggtgaaggagaggaacgcccgctccgtgaagatcaccaagcgcttcaccaagctgctcatcgcgcccgagagcgccgccccggaggaggcgatggggcccgcggaagagcctgagccggggcgcgcgcggcgctcggacacgcacactttcaaccgcctcttccgccgcgacgaggagggccggcggccgctgaccgtggtgctgcagggcccggcgggcatcggcaagaccatggcggccaaaaagatcctgtacgactgggcggcgggcaagctgtaccagggccaggtggacttcgccttcttcatgccctgcggcgagctgctggagaggccgggcacgcgcagcctggctgacctgatcctggaccagtgccccgaccgcggcgcgccggtgccgcagatgctggcccagccgcagcggctgctcttcatcctggacggcgcggacgagctgccggcgctggggggccccgaggccgcgccctgcacagaccccttcgaggcggcgagcggcgcgcgggtgctaggcgggctgctgagcaaggcgctgctgcccacggccctcctgctggtgaccacgcgcgccgccgcccccgggaggctgcagggccgcctgtgttccccgcagtgcgccgaggtgcgcggcttctccgacaaggacaagaagaagtatttctacaagtatttccgggatgagaggagggccgagcgcgcctaccgcttcgtgaaggagaacgagacgctgttcgcgctgtgcttcgtgcccttcgtgtgctggatcgtgtgcaccgtgctgcgccagcagctggagctcggtcgggacctgtcgcgcacgtccaagaccaccacgtcagtgtacctgcttttcatcaccagcgttctgagctcggctccggtagccgacgggccccggttgcagggcgacctgcgcaatctgtgccgcctggcccgcgagggcgtcctcggacgcagggcgcagtttgccgagaaggaactggagcaactggagcttcgtggctccaaagtgcagacgctgtttctcagcaaaaaggagctgccgggcgtgctggagacagaggtcacctaccagttcatcgaccagagcttccaggagttcctcgcggcactgtcctacctgctggaggacggcggggtgcccaggaccgcggctggcggcgttgggacactcctgcgtggggacgcccagccgcacagccacttggtgctcaccacgcgcttcctcttcggactgctgagcgcggagcggatgcgcgacatcgagcgccacttcggctgcatggtttcagagcgtgtgaagcaggaggccctgcggtgggtgcagggacagggacagggctgccccggagtggcaccagaggtgaccgagggggccaaagggctcgaggacaccgaagagccagaggaggaggaggagggagaggagcccaactacccactggagttgctgtactgcctgtacgagacgcaggaggacgcgtttgtgcgccaagccctgtgccggttcccggagctggcgctgcagcgagtgcgcttctgccgcatggacgtggctgttctgagctactgcgtgaggtgctgccctgctggacaggcactgcggctgatcagctgcagattggttgctgcgcaggagaagaagaagaagagcctggggaagcggctccaggccagcctgggtggcggcagcagttctcaaggcaccacaaaacaactgccagcctcccttcttcatccactctttcaggcaatgactgacccactgtgccatctgagcagcctcacgctgtcccactgcaaactccctgacgcggtctgccgagacctttctgaggccctgagggcagcccccgcactgacggagctgggcctcctccacaacaggctcagtgaggcgggactgcgtatgctgagtgagggcctagcctggccgcagtgcagggtgcagacggtcagggtacagctgcctgacccccagcgagggctccagtacctggtgggtatgcttcggcagagccctgccctgaccaccctggatctcagcggctgccaactgcccgcccccatggtgacctacctgtgtgcagtcctgcagcaccagggatgcggcctgcagaccctcagtctggcctctgtggagctgagcgagcagtcactacaggagcttcaggctgtgaagagagcaaagccggatctggtcatcacacacccagcgctggacggccacccacaacctcccaaggaactcatctcgaccttctga

SEQ ID NO: 159779 - DNA, 2936 bp, Homo sapiens
  Payload ID: 11260
  Gene Symbol: NLRP6
  Gene Name: NLR family, pyrin domain containing 6
  Uniprot ID: P59044
  ENST ID: ENST00000534750
  CDS Start-End: 206-2881
aaacggagcccttaaagggcaatgctctgcgtgtgccacggtgcccaacagcatctcgtgccagctgagctgcggtgtgtggacccggggaatggaccgggctggacaacctctaagacttggctccagctcagcctgtgaaggaatcacctctctgatccccacctctgccccggagtgctagacccagggaggaagagaccccatggaccagccagaggccccctgctccagcacggggccgcgcctcgcggtggcccgcgagctgctcctggctgcgctggaggaactgagccaagagcagctgaagcgcttccgccacaagctgcgcgacgtgggcccggacggacgcagcatcccgtgggggcggctggagcgcgcggacgccgtggacctcgcggagcagctggcccagttctacggcccggagcctgccctggaggtggcccgcaagaccctcaagagggcggacgcgcgcgacgtggcggcgcagctccaggagcggcggctgcagcggctcgggctcggctccgggacgctgctctccgtgtccgagtacaagaagaagtaccgggagcacgtgctgcagctgcacgctcgggtgaaggagaggaacgcccgctccgtgaagatcaccaagcgcttcaccaagctgctcatcgcgcccgagagcgccgccccggaggaggcgatggggcccgcggaagagcctgagccggggcgcgcgcggcgctcggacacgcacactttcaaccgcctcttccgccgcgacgaggagggccggcggccgctgaccgtggtgctgcagggcccggcgggcatcggcaagaccatggcggccaaaaagatcctgtacgactgggcggcgggcaagctgtaccagggccaggtggacttcgccttcttcatgccctgcggcgagctgctggagaggccgggcacgcgcagcctggctgacctgatcctggaccagtgccccgaccgcggcgcgccggtgccgcagatgctggcccagccgcagcggctgctcttcatcctggacggcgcggacgagctgccggcgctggggggccccgaggccgcgccctgcacagaccccttcgaggcggcgagcggcgcgcgggtgctaggcgggctgctgagcaaggcgctgctgcccacggccctcctgctggtgaccacgcgcgccgccgcccccgggaggctgcagggccgcctgtgttccccgcagtgcgccgaggtgcgcggcttctccgacaaggacaagaagaagtatttctacaagtatttccgggatgagaggagggccgagcgcgcctaccgcttcgtgaaggagaacgagacgctgttcgcgctgtgcttcgtgcccttcgtgtgctggatcgtgtgcaccgtgctgcgccagcagctggagctcggtcgggacctgtcgcgcacgtccaagaccaccacgtcagtgtacctgcttttcatcaccagcgttctgagctcggctccggtagccgacgggccccggttgcagggcgacctgcgcaatctgtgccgcctggcccgcgagggcgtcctcggacgcagggcgcagtttgccgagaaggaactggagcaactggagcttcgtggctccaaagtgcagacgctgtttctcagcaaaaaggagctgccgggcgtgctggagacagaggtcacctaccagttcatcgaccagagcttccaggagttcctcgcggcactgtcctacctgctggaggacggcggggtgcccaggaccgcggctggcggcgttgggacactcctgcgtggggacgcccagccgcacagccacttggtgctcaccacgcgcttcctcttcggactgctgagcgcggagcggatgcgcgacatcgagcgccacttcggctgcatggtttcagagcgtgtgaagcaggaggccctgcggtgggtgcagggacagggacagggctgccccggagtggcaccagaggtgaccgagggggccaaagggctcgaggacaccgaagagccagaggaggaggaggagggagaggagcccaactacccactggagttgctgtactgcctgtacgagacgcaggaggacgcgtttgtgcgccaagccctgtgccggttcccggagctggcgctgcagcgagtgcgcttctgccgcatggacgtggctgttctgagctactgcgtgaggtgctgccctgctggacaggcactgcggctgatcagctgcagattggttgctgcgcaggagaagaagaagaagagcctggggaagcggctccaggccagcctgggtggcggcagttctcaaggcaccacaaaacaactgccagcctcccttcttcatccactctttcaggcaatgactgacccactgtgccatctgagcagcctcacgctgtcccactgcaaactccctgacgcggtctgccgagacctttctgaggccctgagggcagcccccgcactgacggagctgggcctcctccacaacaggctcagtgaggcgggactgcgtatgctgagtgagggcctagcctggccgcagtgcagggtgcagacggtcagggtacagctgcctgacccccagcgagggctccagtacctggtgggtatgcttcggcagagccctgccctgaccaccctggatctcagcggctgccaactgcccgcccccatggtgacctacctgtgtgcagtcctgcagcaccagggatgcggcctgcagaccctcagtctggcctctgtggagctgagcgagcagtcactacaggagcttcaggctgtgaagagagcaaagccggatctggtcatcacacacccagcgctggacggccacccacaacctcccaaggaactcatctcgaccttctgaggctctggtggccagagcagggtggaagaccctagtcaaagtccctgtggagaga

SEQ ID NO: 159780 - DNA, 3299 bp, Homo sapiens
  Payload ID: 11261
  Gene Symbol: NLRP7
  Gene Name: NLR family, pyrin domain containing 7
  Uniprot ID: Q8WX94
  ENST ID: ENST00000328092
  CDS Start-End: 40-3069
ttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgc

SEQ ID NO: 159781 - DNA, 3250 bp, Homo sapiens
  Payload ID: 11261
  Gene Symbol: NLRP7
  Gene Name: NLR family, pyrin domain containing 7
  Uniprot ID: Q8WX94
  ENST ID: ENST00000340844
  CDS Start-End: 77-3019
gaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 159782 - DNA, 3209 bp, Homo sapiens
  Payload ID: 11261
  Gene Symbol: NLRP7
  Gene Name: NLR family, pyrin domain containing 7
  Uniprot ID: Q8WX94
  ENST ID: ENST00000590030
  CDS Start-End: 42-2984
agttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctc

SEQ ID NO: 159783 - DNA, 3826 bp, Homo sapiens
  Payload ID: 11261
  Gene Symbol: NLRP7
  Gene Name: NLR family, pyrin domain containing 7
  Uniprot ID: Q8WX94
  ENST ID: ENST00000588756
  CDS Start-End: 488-3601
atcttgactgcctgttaaacttacctatgtggagcctcatttcaaagcacgaacgcctagagattctgcttgattggttacactgggactgcccagaccctggagttctttcgagagtcccagataactgtgattgcggccgaggctgagaatcaccgcttagaagcctcagctgtgattggctaccttctcccatcaccccagagtttttaaagctgggagccaggtaccctgcaaaacccaaaatgtgtatttcctgttctgtcgcctatcacacctggcccgggtggtctaggaagggaattgcacattaatctcacctggggagattcagcaagccgtaattctccaaagcccactgaagcccaattacagccaaatccctgaggatggggcccaggtgatgtcaaggaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctc

SEQ ID NO: 159784 - DNA, 559 bp, Homo sapiens
  Payload ID: 11261
  Gene Symbol: NLRP7
  Gene Name: NLR family, pyrin domain containing 7
  ENST ID: ENST00000587103
  CDS Start-End: 350-559
ttttgggggcggggggtgttggggggcggtccttcacctgagcttccggatctccacctgtggtcctccatcttgactgcctgttaaacttacctatgtggagcctcatttcaaagcacgaacgcctagagattctgcttgattggttacactgggactgcccagaccctggagttctttcgagagtcccagataactgtgattgcggccgaggctgagaatcaccgcttagaagcctcagctgtgattggctaccttctcccatcaccccaggaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcg

SEQ ID NO: 159785 - DNA, 568 bp, Homo sapiens
  Payload ID: 11261
  Gene Symbol: NLRP7
  Gene Name: NLR family, pyrin domain containing 7
  ENST ID: ENST00000590659
  CDS Start-End: 408-568
atcttgactgcctgttaaacttacctatgtggagcctcatttcaaagcacgaacgcctagagattctgcttgattggttacactgggactgcccagaccctggagttctttcgagagtcccagataactgtgattgcggccgaggctgagaatcaccgcttagaagcctcagctgtgattggctaccttctcccatcaccccaggaagggaattgcacattaatctcacctggggagattcagcaagccgtaattctccaaagcccactgaagcccaattacagccaaatccctgaggatggggcccaggtgatgtcaaggtgagcctgaggaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaact

SEQ ID NO: 159786 - DNA, 543 bp, Homo sapiens
  Payload ID: 11261
  Gene Symbol: NLRP7
  Gene Name: NLR family, pyrin domain containing 7
  ENST ID: ENST00000587844
  CDS Start-End: 254-543
gtggtcctccatcttgactgcctgttaaacttacctatgtggagcctcatttcaaagcacgaacgcctagagattctgcttgattggttacactgggactgcccagaccctggagttctttcgagagtcccagataactgtgattgcggccgaggctgagaatcaccgcttagaagcctcagctgtgattggctaccttctcccatcaccccagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggt

SEQ ID NO: 159787 - DNA, 3233 bp, Homo sapiens
  Payload ID: 11261
  Gene Symbol: NLRP7
  Gene Name: NLR family, pyrin domain containing 7
  ENST ID: ENST00000586379
  CDS Start-End: 69-2960
ggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgt

SEQ ID NO: 159788 - DNA, 3269 bp, Homo sapiens
  Payload ID: 11261
  Gene Symbol: NLRP7
  Gene Name: NLR family, pyrin domain containing 7
  Uniprot ID: Q8WX94
  ENST ID: ENST00000592784
  CDS Start-End: 69-3182
ggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatg

SEQ ID NO: 159789 - DNA, 3149 bp, Homo sapiens
  Payload ID: 11261
  Gene Symbol: NLRP7
  Gene Name: NLR family, pyrin domain containing 7
  ENST ID: ENST00000622173
  CDS Start-End: 69-2876
ggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgt

SEQ ID NO: 159790 - DNA, 683 bp, Homo sapiens
  Payload ID: 11261
  Gene Symbol: NLRP7
  Gene Name: NLR family, pyrin domain containing 7
  ENST ID: ENST00000615467
  CDS Start-End: 1-472
gttacagcaatgcagcataaccaagcttggctgtagatacctctcagaggcgctccaagaagcctgcagcctcacaaacctggacttgagtatcaaccagatagctcgtggattgtggattctctgtcaggcgttagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaa

SEQ ID NO: 159791 - DNA, 3250 bp, Homo sapiens; identical to SEQ ID NO: 159781
  Payload ID: 11261
  Gene Symbol: NLRP7
  Gene Name: NLR family, pyrin domain containing 7
  Uniprot ID: Q8WX94
  ENST ID: ENST00000610790
  CDS Start-End: 77-3019

SEQ ID NO: 159792 - DNA, 559 bp, Homo sapiens; identical to SEQ ID NO: 159784
  Payload ID: 11261
  Gene Symbol: NLRP7
  Gene Name: NLR family, pyrin domain containing 7
  ENST ID: ENST00000618592
  CDS Start-End: 350-559

SEQ ID NO: 159793 - DNA, 3250 bp, Homo sapiens
  Payload ID: 11261
  Gene Symbol: NLRP7
  Gene Name: NLR family, pyrin domain containing 7
  ENST ID: ENST00000614922
  CDS Start-End: 77-3019
gaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 159794 - DNA, 3299 bp, Homo sapiens; identical to SEQ ID NO: 159780
  Payload ID: 11261
  Gene Symbol: NLRP7
  Gene Name: NLR family, pyrin domain containing 7
  Uniprot ID: Q8WX94
  ENST ID: ENST00000610853
  CDS Start-End: 40-3069

SEQ ID NO: 159795 - DNA, 3421 bp, Homo sapiens
  Payload ID: 11261
  Gene Symbol: NLRP7
  Gene Name: NLR family, pyrin domain containing 7
  ENST ID: ENST00000610981
  CDS Start-End: 77-3190
gaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 159796 - DNA, 3250 bp, Homo sapiens; identical to SEQ ID NO: 159781
  Payload ID: 11261
  Gene Symbol: NLRP7
  Gene Name: NLR family, pyrin domain containing 7
  Uniprot ID: Q8WX94
  ENST ID: ENST00000621584
  CDS Start-End: 77-3019

SEQ ID NO: 159797 - DNA, 543 bp, Homo sapiens; identical to SEQ ID NO: 159786
  Payload ID: 11261
  Gene Symbol: NLRP7
  Gene Name: NLR family, pyrin domain containing 7
  ENST ID: ENST00000622467
  CDS Start-End: 254-543

SEQ ID NO: 159798 - DNA, 3250 bp, Homo sapiens
  Payload ID: 11261
  Gene Symbol: NLRP7
  Gene Name: NLR family, pyrin domain containing 7
  ENST ID: ENST00000620183
  CDS Start-End: 77-3019
gaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatacctctcagaggcgctccaagaagcctgcagcctcacaaacctggacttgagtatcaaccagatagctcgtggattgtggattctctgtcaggcgttagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 159799 - DNA, 3421 bp, Homo sapiens
  Payload ID: 11261
  Gene Symbol: NLRP7
  Gene Name: NLR family, pyrin domain containing 7
  ENST ID: ENST00000618343
  CDS Start-End: 77-3190
gaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacagtctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacgccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatacctctcagaggcgctccaagaagcctgcagcctcacaaacctggacttgagtatcaaccagatagctcgtggattgtggattctctgtcaggcgttagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 159800 - DNA, 3250 bp, Homo sapiens; identical to SEQ ID NO: 159781
  Payload ID: 11261
  Gene Symbol: NLRP7
  Gene Name: NLR family, pyrin domain containing 7
  Uniprot ID: Q8WX94
  ENST ID: ENST00000615699
  CDS Start-End: 77-3019

SEQ ID NO: 159801 - DNA, 3233 bp, Homo sapiens; identical to SEQ ID NO: 159787
  Payload ID: 11261
  Gene Symbol: NLRP7
  Gene Name: NLR family, pyrin domain containing 7
  ENST ID: ENST00000621903
  CDS Start-End: 69-2960

SEQ ID NO: 159802 - DNA, 3209 bp, Homo sapiens; identical to SEQ ID NO: 159782
  Payload ID: 11261
  Gene Symbol: NLRP7
  Gene Name: NLR family, pyrin domain containing 7
  Uniprot ID: Q8WX94
  ENST ID: ENST00000611597
  CDS Start-End: 42-2984

SEQ ID NO: 159803 - DNA, 3826 bp, Homo sapiens; identical to SEQ ID NO: 159783
  Payload ID: 11261
  Gene Symbol: NLRP7
  Gene Name: NLR family, pyrin domain containing 7
  Uniprot ID: Q8WX94
  ENST ID: ENST00000621238
  CDS Start-End: 488-3601

SEQ ID NO: 159804 - DNA, 3421 bp, Homo sapiens; identical to SEQ ID NO: 159795
  Payload ID: 11261
  Gene Symbol: NLRP7
  Gene Name: NLR family, pyrin domain containing 7
  Uniprot ID: Q8WX94
  ENST ID: ENST00000618672
  CDS Start-End: 77-3190

SEQ ID NO: 159805 - DNA, 523 bp, Homo sapiens
  Payload ID: 11261
  Gene Symbol: NLRP7
  Gene Name: NLR family, pyrin domain containing 7
  ENST ID: ENST00000613487
  CDS Start-End: 1-250
gttacagcaatgcagcataaccaagcttggctgtagatacctctcagaggcgctccaagaagcctgcagcctcacaaacctggacttgagtatcaaccagatagctcgtggattgtggattctctgtcaggcgttagagaatccaaactgtaacctaaaacacctacgcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgt

SEQ ID NO: 159806 - DNA, 3160 bp, Homo sapiens
  Payload ID: 11261
  Gene Symbol: NLRP7
  Gene Name: NLR family, pyrin domain containing 7
  ENST ID: ENST00000619082
  CDS Start-End: 71-2929
caggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 159807 - DNA, 3421 bp, Homo sapiens
  Payload ID: 11261
  Gene Symbol: NLRP7
  Gene Name: NLR family, pyrin domain containing 7
  ENST ID: ENST00000621787
  CDS Start-End: 77-3190
gaaacacaggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaaggtgcacttacctaaccattccgaactgggctcggcaggatcttcgctctcttcgcctctggacagatttctgctctctcttcagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 159808 - DNA, 3250 bp, Homo sapiens; identical to SEQ ID NO: 159781
  Payload ID: 11261
  Gene Symbol: NLRP7
  Gene Name: NLR family, pyrin domain containing 7
  ENST ID: ENST00000618995
  CDS Start-End: 77-3019

SEQ ID NO: 159809 - DNA, 532 bp, Homo sapiens
  Payload ID: 11261
  Gene Symbol: NLRP7
  Gene Name: NLR family, pyrin domain containing 7
  ENST ID: ENST00000613325
  CDS Start-End: 1-301
gttacagcaatgcagcataaccaagcttggctgtagatacctctcagaggcgctccaagaagcctgcagcctcacaaacctggacttgagtatcaaccagatagctcgtggattgtggattctctgtcaggcgttagagaatccaaactgtaacctaaaacacctacggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgca

SEQ ID NO: 159810 - DNA, 3421 bp, Homo sapiens; identical to SEQ ID NO: 159795
  Payload ID: 11261
  Gene Symbol: NLRP7
  Gene Name: NLR family, pyrin domain containing 7
  Uniprot ID: Q8WX94
  ENST ID: ENST00000622199
  CDS Start-End: 77-3190

SEQ ID NO: 159811 - DNA, 3421 bp, Homo sapiens; identical to SEQ ID NO: 159795
  Payload ID: 11261
  Gene Symbol: NLRP7
  Gene Name: NLR family, pyrin domain containing 7
  ENST ID: ENST00000620820
  CDS Start-End: 77-3190

SEQ ID NO: 159812 - DNA, 568 bp, Homo sapiens; identical to SEQ ID NO: 159785
  Payload ID: 11261
  Gene Symbol: NLRP7
  Gene Name: NLR family, pyrin domain containing 7
  ENST ID: ENST00000620334
  CDS Start-End: 408-568

SEQ ID NO: 159813 - DNA, 3269 bp, Homo sapiens; identical to SEQ ID NO: 159788
  Payload ID: 11261
  Gene Symbol: NLRP7
  Gene Name: NLR family, pyrin domain containing 7
  Uniprot ID: Q8WX94
  ENST ID: ENST00000610424
  CDS Start-End: 69-3182

SEQ ID NO: 159814 - DNA, 3250 bp, Homo sapiens; identical to SEQ ID NO: 159781
  Payload ID: 11261
  Gene Symbol: NLRP7
  Gene Name: NLR family, pyrin domain containing 7
  ENST ID: ENST00000613233
  CDS Start-End: 77-3019

SEQ ID NO: 159815 - DNA, 3250 bp, Homo sapiens; identical to SEQ ID NO: 159781
  Payload ID: 11261
  Gene Symbol: NLRP7
  Gene Name: NLR family, pyrin domain containing 7
  Uniprot ID: Q8WX94
  ENST ID: ENST00000618261
  CDS Start-End: 77-3019

SEQ ID NO: 159816 - DNA, 3325 bp, Homo sapiens
  Payload ID: 11261
  Gene Symbol: NLRP7
  Gene Name: NLR family, pyrin domain containing 7
  ENST ID: ENST00000619096
  CDS Start-End: 71-3100
caggctggaagcaagacctgacctgagggagttcttcagccttaacctaaggtctcatactcggagcactatgacatcgccccagctagagtggactctgcagacccttctggagcagctgaacgaggatgaattaaagagtttcaaatcccttttatgggcttttcccctcgaagacgtgctacagaagaccccatggtctgaggtggaagaggctgatggcaagaaactggcagaaattctggtcaacacctcctcagaaaattggataaggaatgcgactgtgaacatcttggaagagatgaatctcacggaattgtgtaagatggcaaaggctgagatgatggaggacggacaggtgcaagaaatagataatcctgagctgggagatgcagaagaagactcggagttagcaaagccaggtgaaaaggaaggatggagaaattcaatggagaaacaatctttggtctggaagaacaccttttggcaaggagacattgacaatttccatgacgacgtcactctgagaaaccaacggttcattccattcttgaatcccagaacacccaggaagctaacaccttacacggtggtgctgcacggccccgcaggcgtggggaaaaccacgctggccaaaaagtgtatgctggactggacagactgcaacctcagcccgacgctcagatacgcgttctacctcagctgcaaggagctcagccgcatgggcccctgcagttttgcagagctgatctccaaagactggcctgaattgcaggatgacattccaagcatcctagcccaagcacagagaatcctgttcgtggtcgatggccttgatgagctgaaagtcccacctggggcgctgatccaggacatctgcggggactgggagaagaagaagccggtgcccgtcctcctggggagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggattgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagatgtccgtgttccaccgagaggacctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggagggggaggacagggacggccacgcctgggacatcggggacgtacagaagctgctttccggagaagaaagactcaagaaccccgacctgattcaagtaggacacttcttattcggcctcgctaacgagaagagagccaaggagttggaggccacttttggctgccggatgtcaccggacatcaaacaggaattgctgcaatgcaaagcacatcttcatgcaaataagcccttatccgtgaccgacctgaaggaggtcttgggctgcctgtatgagtctcaggaggaggagctggcgaaggtggtggtggccccgttcaaggaaatttctattcacctgacaaatacttctgaagtgatgcattgttccttcagcctgaagcattgtcaagacttgcagaaactctcactgcaggtagcaaagggggtgttcctggagaattacatggattttgaactggacattgaatttgaaagctcaaacagcaacctcaagtttctggaagtgaaacaaagcttcctgagtgactcttctgtgcggattctttgtgaccacgtaacccgtagcacctgtcatctgcagaaagtggagattaaaaacgtcacccctgacaccgcgtaccgggacttctgtcttgctttcattgggaagaagaccctcacgcacctgaccctggcagggcacatcgagtgggaacgcacgatgatgctgatgctgtgtgacctgctcagaaatcataaatgcaacctgcagtacctgaggttgggaggtcactgtgccaccccggagcagtgggctgaattcttctatgtcctcaaagccaaccagtccctgaagcacctgcgtctctcagccaatgtgctcctggatgagggtgccatgttgctgtacaagaccatgacacgcccaaaacacttcctgcagatgttgtcgttggaaaactgtcgtcttacagaagccagttgcaaggaccttgctgctgtcttggttgtcagcaagaagctgacacacctgtgcttggccaagaaccccattggggatacaggggtgaagtttctgtgtgagggcttgagttaccctgattgtaaactgcagaccttggtgttacagcaatgcagcataaccaagcttggctgtagatatctctcagaggcgctccaagaagcctgcagcctcacaaacctggacttgagtatcaaccagatagctcgtggattgtggattctctgtcaggcattagagaatccaaactgtaacctaaaacacctacgcctctggagctgctccctcatgcctttctattgtcagcatcttggatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctc

SEQ ID NO: 159817 - DNA, 3421 bp, Homo sapiens; identical to SEQ ID NO: 159795
  Payload ID: 11261
  Gene Symbol: NLRP7
  Gene Name: NLR family, pyrin domain containing 7
  ENST ID: ENST00000615426
  CDS Start-End: 77-3190

SEQ ID NO: 159818 - DNA, 3250 bp, Homo sapiens; identical to SEQ ID NO: 159781
  Payload ID: 11261
  Gene Symbol: NLRP7
  Gene Name: NLR family, pyrin domain containing 7
  ENST ID: ENST00000614879
  CDS Start-End: 77-3019

SEQ ID NO: 159819 - DNA, 3421 bp, Homo sapiens; identical to SEQ ID NO: 159795
  Payload ID: 11261
  Gene Symbol: NLRP7
  Gene Name: NLR family, pyrin domain containing 7
  Uniprot ID: Q8WX94
  ENST ID: ENST00000618740
  CDS Start-End: 77-3190

SEQ ID NO: 159820 - DNA, 3934 bp, Homo sapiens
  Payload ID: 11262
  Gene Symbol: NLRP8
  Gene Name: NLR family, pyrin domain containing 8
  Uniprot ID: Q86W28
  ENST ID: ENST00000291971
  CDS Start-End: 72-3218
gtctcgtgtttctctcttccaatcggttgtctttatcgtggacactgaggtgttctctgccttgactaaagatgagtgacgtgaatccaccctctgacacccccattcccttttcatcctcctccactcacagttctcatattccgccctggacattctcttgctaccccggctccccatgtgaaaatggggtcatgctgtacatgagaaacgtgagccatgaggagctacaacggttcaagcagctcttactgactgagctcagtactggcaccatgcccatcacctgggaccaggtcgagacagccagctgggcagaggtggttcatctcttgatagagcgtttccctggacgacgcgcttgggatgtgacttcgaacatctttgccattatgaactgtgataaaatgtgtgttgtagtccgcagagagataaatgccattctgcctaccttggaaccagaggacttgaatgtgggagaaacacaggtgaatctggaggaaggagaatctggtaaaatacggcggtataaatcgaatgtgatggaaaagtttttccccatatgggacattacgacttggcctggaaaccagagggacttcttctaccaaggtgtacacaggcacgaggagtacttaccatgtctgcttctgcccaaaagaccccagggtagacagcccaagaccgtggccatacagggagctcctgggatcggaaaaacaatcctggccaaaaaggtgatgtttgagtgggccagaaacaagttctacgcccacaagcgctggtgtgctttctacttccattgccaagaggtgaaccagacgacagaccagagcttctccgagctgattgagcaaaagtggcctggatctcaggacctcgtgtcaaagattatgtccaaacccgaccaacttctgctgctcttggatggctttgaggagctcacatctaccctcattgacagactggaggacctgagtgaagactggaggcagaaattgcctgggtctgtcctactgagcagtttgctgagcaaaacgatgcttccagaggccacgctactgatcatgataagatttacctcttggcagacatgcaagcccttgctgaaatgtccctctctcgtaacccttccggggtttaatacgatggaaaaaatcaagtatttccagatgtattttggacacacagaggagggagaccaagtcttgagtttcgccatggaaaacaccattctcttctccatgtgccgggtccctgtggtttgctggatggtctgctctggtctgaaacagcaaatggagagaggaaacaatctcacacagtcatgtccaaatgccacctctgtgttcgtccggtatatttctagcttgtttcccaccagagctgagaacttttccagaaagatccaccaagcacaactggaaggtctgtgtcacttggccgcagacagcatgtggcacaggaaatgggtgttaggtaaagaagatcttgaggaagccaagctggatcagacgggagtcaccgccttccttggcatgagtattcttcggagaattgcaggtgaggaagaccactatgtctttaccctcgtgacttttcaggaattttttgcggccttgttttatgttctctgtttcccacaaagactcaaaaattttcatgtgttgagccacgtgaatatccagcgcctgatagcgagtcccagaggaagcaaaagctatctctctcacatgggacttttcttattcggttttctgaacgaggcctgcgcttcggccgtggaacagtcattccaatgcaaggtgtctttcggtaataagaggaaactgctgaaagtcatacctctgttgcataaatgtgacccaccttctccgggcagtggggtcccgcagttattctactgtctgcatgaaatccgggaggaagcctttgtaagccaagccctaaatgattatcataaagttgtcttgagaattggcaacaacaaagaagttcaagtgtctgctttttgcctgaagcggtgtcaatatttgcatgaggtggaactgaccgtcaccctgaacttcatgaacgtgtggaagctcagctccagctcccatcctggctctgaagcgccagagagcaatgggctgcatcgttggtggcaagacttatgctctgtgtttgcaacgaatgataagctggaagtcctgactatgaccaacagtgttttggggcctccttttttgaaggctctcgcggccgcactgaggcaccctcagtgcaaactgcaaaagctactcctaaggcgtgtgaatagcaccatgttgaaccaggacttaatcggtgttttgacggggaaccagcatctgagatacttggaaatacaacatgtggaagtggagtccaaagctgtgaagcttctatgcagggtgctgagatccccccggtgccgtctgcagtgtctcaggttggaagactgcttggccacccctagaatttggactgatcttggcaataatcttcaaggtaacgggcatctaaagactctcatactaagaaaaaactccctggagaactgtggggcgtattacctgtctgtggcccagctggagaggctgtcgatagagaactgcaaccttacacagcttacttgtgaaagccttgcctcctgtctcaggcagagtaagatgctgacccacctgagcttggcagaaaacgccttgaaagatgaaggggccaagcatatttggaatgccctgccacacctgagatgtcctctgcagaggctggtactgagaaagtgtgacttgacctttaattgctgtcaggatatgatctctgcgctctgtaaaaataaaaccctgaaaagtcttgacctaagttttaatagcctgaaggatgatggggtgatcctgctgtgtgaggccctgaagaaccctgactgtacattacagatcctggagctggaaaactgcctgttcacctccatctgctgccaggccatggcttccatgctccgcaaaaaccaacatctgagacatctggacttgagcaagaatgcgattggagtctatggtattctgaccttgtgcgaggccttctcaagccaaaagaagagagaagaggtcattttctgtattcctgcctggactcgaataactagcttctccccaactcctcacccacccgacttcacgggaaaaagtgactgcctatcccagattaatccttaggccgtccagtcatctttctctggggcttgattgatcagttcccactctgacaactggcaaataccaggcgttatcatcctgtatgcattaacgtactttcccctgaaacagagcaacccagtcaacaccacagaacctcagctttgaaccctggagtgaggacggtgatgccctgtgtgtattaatatgctatgtaaggctgggcgtggtggctcacgcctgtaacccagcactatgggaggtcgaggtgggcagattacctgaggtcaggagttccagaccagcctggccaacatggtgaaaccccgcctctactaaaaaaaaaaatacaaaaaattaggcgtggtggtgggctcctgtaatcccagctgctcgggaggctgaggcaggagaatcacttgaatctaggaggcagagtttgcagtgagctgagatcacgccattgcactccagcctgggcgacagagcaagactctgtctcaagaagaaaaaaaaaatacatatacacataaatatatatatgtgtgtgtgtatatatatatatatatatatatatgctatataaagtttaaatgaaatgctttgagtcacctaagacaggatatagacaaagtcttcatcgtcttcttgcttcttctacctttatttattctcagctctgaatgtatgaacctgctcaatcacctcatcttaaaaataaaatcactgtccctaga

SEQ ID NO: 159821 - DNA, 3090 bp, Homo sapiens
  Payload ID: 11262
  Gene Symbol: NLRP8
  Gene Name: NLR family, pyrin domain containing 8
  Uniprot ID: Q86W28
  ENST ID: ENST00000590542
  CDS Start-End: 1-3090
atgagtgacgtgaatccaccctctgacacccccattcccttttcatcctcctccactcacagttctcatattccgccctggacattctcttgctaccccggctccccatgtgaaaatggggtcatgctgtacatgagaaacgtgagccatgaggagctacaacggttcaagcagctcttactgactgagctcagtactggcaccatgcccatcacctgggaccaggtcgagacagccagctgggcagaggtggttcatctcttgatagagcgtttccctggacgacgcgcttgggatgtgacttcgaacatctttgccattatgaactgtgataaaatgtgtgttgtagtccgcagagagataaatgccattctgcctaccttggaaccagaggacttgaatgtgggagaaacacaggtgaatctggaggaaggagaatctggtaaaatacggcggtataaatcgaatgtgatggaaaagtttttccccatatgggacattacgacttggcctggaaaccagagggacttcttctaccaaggtgtacacaggcacgaggagtacttaccatgtctgcttctgcccaaaagaccccagggtagacagcccaagaccgtggccatacagggagctcctgggatcggaaaaacaatcctggccaaaaaggtgatgtttgagtgggccagaaacaagttctacgcccacaagcgctggtgtgctttctacttccattgccaagaggtgaaccagacgacagaccagagcttctccgagctgattgagcaaaagtggcctggatctcaggacctcgtgtcaaagattatgtccaaacccgaccaacttctgctgctcttggatggctttgaggagctcacatctaccctcattgacagactggaggacctgagtgaagactggaggcagaaattgcctgggtctgtcctactgagcagtttgctgagcaaaacgatgcttccagaggccacgctactgatcatgataagatttacctcttggcagacatgcaagcccttgctgaaatgtccctctctcgtaacccttccggggtttaatacgatggaaaaaatcaagtatttccagatgtattttggacacacagaggagggagaccaagtcttgagtttcgccatggaaaacaccattctcttctccatgtgccgggtccctgtggtttgctggatggtctgctctggtctgaaacagcaaatggagagaggaaacaatctcacacagtcatgtccaaatgccacctctgtgttcgtccggtatatttctagcttgtttcccaccagagctgagaacttttccagaaagatccaccaagcacaactggaaggtctgtgtcacttggccgcagacagcatgtggcacaggaaatgggtgttaggtaaagaagatcttgaggaagccaagctggatcagacgggagtcaccgccttccttggcatgagtattcttcggagaattgcaggtgaggaagaccactatgtctttaccctcgtgacttttcaggaattttttgcggccttgttttatgttctctgtttcccacaaagactcaaaaattttcatgtgttgagccacgtgaatatccagcgcctgatagcgagtcccagaggaagcaaaagctatctctctcacatgggacttttcttattcggttttctgaacgaggcctgcgcttcggccgtggaacagtcattccaatgcaaggtgtctttcggtaataagaggaaactgctgaaagtcatacctctgttgcataaatgtgacccaccttctccgggcagtggggtcccgcagttattctactgtctgcatgaaatccgggaggaagcctttgtaagccaagccctaaatgattatcataaagttgtcttgagaattggcaacaacaaagaagttcaagtgtctgctttttgcctgaagcggtgtcaatatttgcatgaggtggaactgaccgtcaccctgaacttcatgaacgtgtggaagctcagctccagctcccatcctggctctgaagcgccagagagcaatgggctgcatcgttggtggcaagacttatgctctgtgtttgcaacgaatgataagctggaagtcctgactatgaccaacagtgttttggggcctccttttttgaaggctctcgcggccgcactgaggcaccctcagtgcaaactgcaaaagctactcctaaggcgtgtgaatagcaccatgttgaaccaggacttaatcggtgttttgacggggaaccagcatctgagatacttggaaatacaacatgtggaagtggagtccaaagctgtgaagcttctatgcagggtgctgagatccccccggtgccgtctgcagtgtctcaggttggaagactgcttggccacccctagaatttggactgatcttggcaataatcttcaaggtaacgggcatctaaagactctcatactaagaaaaaactccctggagaactgtggggcgtattacctgtctgtggcccagctggagaggctgtcgcagagtaagatgctgacccacctgagcttggcagaaaacgccttgaaagatgaaggggccaagcatatttggaatgccctgccacacctgagatgtcctctgcagaggctggtactgagaaagtgtgacttgacctttaattgctgtcaggatatgatctctgcgctctgtaaaaataaaaccctgaaaagtcttgacctaagttttaatagcctgaaggatgatggggtgatcctgctgtgtgaggccctgaagaaccctgactgtacattacagatcctggagctggaaaactgcctgttcacctccatctgctgccaggccatggcttccatgctccgcaaaaaccaacatctgagacatctggacttgagcaagaatgcgattggagtctatggtattctgaccttgtgcgaggccttctcaagccaaaagaagagagaagaggtcattttctgtattcctgcctggactcgaataactagcttctccccaactcctcacccacccgacttcacgggaaaaagtgactgcctatcccagattaatccttag

SEQ ID NO: 159822 - DNA, 3484 bp, Homo sapiens
  Payload ID: 11263
  Gene Symbol: NLRP9
  Gene Name: NLR family, pyrin domain containing 9
  Uniprot ID: Q7RTR0
  ENST ID: ENST00000332836
  CDS Start-End: 29-3004
acacctcagttcacaatcctggggcgatatggcagaatcttttttttcggattttggcttgttgtggtatctgaaggagctcagaaaggaagagttttggaaatttaaggagctcctcaaacaacctttggagaaatttgaactcaagccaatcccctgggctgagctgaagaaggcctccaaagaagatgtagcaaagctgctggacaaacattacccaggaaagcaggcatgggaggtaacactgaacctgtttctacagatcaataggaaagatctctggacaaaggctcaggaagagatgagaaataagctaaacccatacagaaagcatatgaaggaaacatttcaactcatatgggagaaggaaacctgtcttcacgtccctgagcatttctacaaagaaaccatgaaaaatgagtataaagaattgaatgacgcatatactgctgcggctagacgacacactgtggtcctggaaggtcctgatggaattggaaaaacaacccttttaagaaaagtgatgttggactgggcagagggaaacttatggaaggacaggttcacatttgtgtttttcctcaatgtctgtgaaatgaacggtatcgcagagaccagcttactggagctcctctctagggactggccggagtcttcagagaagatcgaagacattttttcccagccagagagaattctgttcatcatggatggctttgagcaactgaagtttaacttacaacttaaggctgacttgagcgatgattggaggcagcggcagccaatgccaattatcctgagcagtttgttgcaaaaaaagatgcttccagaatcctctctccttattgcattaggaaaactggctatgcaaaaacactattttatgttgcggcatccaaaactcataaagctcttaggattcagtgaatctgaaaagaagtcgtatttctcctacttctttggtgagaagagcaaagccctgaaagtcttcaattttgtgagagataatgggccgctgtttatcttgtgccataatccctttacgtgctggttggtctgtacttgtgtgaaacagaggctagagaggggagaagaccttgaaataaactcccaaaacaccacctatttatatgcatcctttttaacaactgtattcaaagcaggaagtcagagttttccacctaaggtgaacagagcccgactaaaaagcctgtgtgctttggctgcagagggaatttggacatatacatttgtattttcccatggggatctccggaggaatgggttatctgagtctgagggcgtgatgtgggtgggtatgagactcctccaaaggagaggggactgttttgccttcatgcatctgtgtatccaagagttttgtgccgccatgttttatttgctcaaacgacccaaagacgatcctaacccggccattggaagcataacccagcttgtaagagcaagtgtggttcagcctcaaaccctcttgacccaggtggggatattcatgtttggaatttcaacagaagaaatcgtcagcatgctggagacctcctttggttttccactgtcaaaagacctaaagcaggaaataacccaatgccttgaaagtttaagtcaatgtgaagctgatagggaagccatagctttccaggaactattcattggtttgtttgaaactcaggaaaaagaatttgtaaccaaagtgatgaatttctttgaagaagttttcatttatattggtaacatagaacatttggtaatagcttcattctgcctgaagcattgtcaacatttaacgacacttcgcatgtgtgtggagaatatctttccagatgactcaggatgcatctcagattacaatgagaagctcgtctactggcgggagctttgctcaatgttcattaccaacaagaacttccagattttagacatggaaaataccagcctcgatgatccctccctggcgattctttgcaaagcgctggctcagcctgtttgtaaactccgaaaactcatatttacttctgtgtactttggacatgattcagaattatttaaggcagttcttcacaaccctcatctgaaacttctgagcctgtacggcactagcctctcccagtctgacatcagacacctgtgtgagacgctgaaacatccaatgtgcaagatagaagagctgatactgggaaagtgtgacatctccagtgaagtttgtgaagacatcgcctccgtcctggcctgcaacagcaagctgaaacacctctccttggtagaaaatcccttgagggacgaaggaatgacgttgctgtgtgaagccctgaagcactcacactgtgccctggagaggctgatgttgatgtactgctgtctcacctctgtctcctgtgactccatttccgaagtcctcttgtgcagtaagtccctgtccctcctcgatctgggctcaaatgccctggaagataatggagtggcatctctgtgtgcagcgctgaagcacccaggctgcagcatacgggagctgtggttgatgggctgtttccttacttccgattcctgtaaggacattgctgctgttcttatttgcaatgggaaactgaagaccctgaaacttgggcataatgaaataggagacactggtgtcagacagttatgtgcagctttgcagcatcctcactgtaaattagagtgtctcgggctgcaaacgtgtccgatcacccgtgcctgctgcgacgacatcgccgcagcactcatcgcctgcaaaacactgaggagcctgaacctcgactggattgccttggatgctgatgcagtggtggtgctgtgtgaggcattgagccacccggactgtgccctgcagatgctggggctgcacaaatctggctttgatgaagaaactcagaagatcctgatgtctgtggaagaaaaaattccccatctgaccatttcacatggaccttggattgacgaggaatacaagatcaggggtgtgctcctctgatggggaacaccctgaagtagtcgtctcacaaaggctttccttggccacagtgggaccttcacctggcacctctatcctgtaattgcacatcatggcagcagggctgtgatttcagaggtactccctaagtgttctagcaatatgattatggagtgtgattcagtgtacatgctgattgtctttgcctcggtcctatatccccttgtctttagaaatcccatcctgccttgtgatatttagaagcacaagtacgttaaacaagtgctaaacgctctggaaagcatggctttattttcttaatggatgtcttggtgtgtaggagcatgcatttgtaggcaccacaatccggatacttctgacacagaagtgatgctagaatgtgtctatagattgtattgctagcatccagactttctagtttgtccagatttcgatttgatcaattttcttgtccaataaaaaagcatttccaaatctcta

SEQ ID NO: 159823 - DNA, 2958 bp, Homo sapiens
  Payload ID: 11263
  Gene Symbol: NLRP9
  Gene Name: NLR family, pyrin domain containing 9
  Uniprot ID: Q7RTR0
  ENST ID: ENST00000590200
  CDS Start-End: 1-2958
atggcagaatcttttttttcggattttggcttgttgtggtatctgaaggagctcagaaaggaagagttttggaaatttaaggagctcctcaaacaacctttggagaaatttgaactcaagccaatcccctgggctgagctgaagaaggcctccaaagaagatgtagcaaagctgctggacaaacattacccaggaaagcaggcatgggaggtaacactgaacctgtttctacagatcaataggaaagatctctggacaaaggctcaggaagagatgagaaataagctaaacccatacagaaagcatatgaaggaaacatttcaactcatatgggagaaggaaacctgtcttcacgtccctgagcatttctacaaagaaaccatgaaaaatgagtataaagaattgaatgacgcatatactgctgcggctagacgacacactgtggtcctggaaggtcctgatggaattggaaaaacaacccttttaagaaaagtgatgttggactgggcagagggaaacttatggaaggacaggttcacatttgtgtttttcctcaatgtctgtgaaatgaacggtatcgcagagaccagcttactggagctcctctctagggactggccggagtcttcagagaagatcgaagacattttttcccagccagagagaattctgttcatcatggatggctttgagcaactgaagtttaacttacaacttaaggctgacttgagcgatgattggaggcagcggcagccaatgccaattatcctgagcagtttgttgcaaaaaaagatgcttccagaatcctctctccttattgcattaggaaaactggctatgcaaaaacactattttatgttgcggcatccaaaactcataaagctcttaggattcagtgaatctgaaaagaagtcgtatttctcctacttctttggtgagaagagcaaagccctgaaagtcttcaattttgtgagagataatgggccgctgtttatcttgtgccataatccctttacgtgctggttggtctgtacttgtgtgaaacagaggctagagaggggagaagaccttgaaataaactcccaaaacaccacctatttatatgcatcctttttaacaactgtattcaaagcaggaagtcagagttttccacctaaggtgaacagagcccgactaaaaagcctgtgtgctttggctgcagagggaatttggacatatacatttgtattttcccatggggatctccggaggaatgggttatctgagtctgagggcgtgatgtgggtgggtatgagactcctccaaaggagaggggactgttttgccttcatgcatctgtgtatccaagagttttgtgccgccatgttttatttgctcaaacgacccaaagacgatcctaacccggccattggaagcataacccagcttgtaagagcaagtgtggttcagcctcaaaccctcttgacccaggtggggatattcatgtttggaatttcaacagaagaaatcgtcagcatgctggagacctcctttggttttccactgtcaaaagacctaaagcaggaaataacccaatgccttgaaagtttaagtcaatgtgaagctgatagggaagccatagctttccaggaactattcattggtttgtttgaaactcaggaaaaagaatttgtaaccaaagtgatgaatttctttgaagaagttttcatttatattggtaacatagaacatttggtaatagcttcattctgcctgaagcattgtcaacatttaacgacacttcgcatgtgtgtggagaatatctttccagatgactcaggatgcatctcagattacaatgagaagctcgtctactggcgggagctttgctcaatgttcattaccaacaagaacttccagattttagacatggaaaataccagcctcgatgatccctccctggcgattctttgcaaagcgctggctcagcctgtttgtaaactccgaaaactcatatttacttctgtgtactttggacatgattcagaattatttaaggcagttcttcacaaccctcatctgaaacttctgagcctgtacggcactagcctctcccagtctgacatcagacacctgtgtgagacgctgaaacatccaatgtgcaagatagaagagctgatactgggaaagtgtgacatctccagtgaagtttgtgaagacatcgcctccgtcctggcctgcaacagcaagctgaaacacctctccttggtagaaaatcccttgagggacgaaggaatgacgttgctgtgtgaagccctgaagcactcacactgtgccctggagaggctgatgttgatgtactgctgtctcacctctgtctcctgtgactccatttccgaagtcctcttgtgcagtaagtccctgtccctcctcgatctgggctcaaatgccctggaagataatggagtggcatctctgtgtgcagcgctgaagcacccaggctgcagcatacgggagctgtggttgatgggctgtttccttacttccgattcctgtaaggacattgctgctgttcttatttgcaatgggaaactgaagaccctgaaacttgggcataatgaaataggagacactggtgtcagacagttatgtgcagctttgcagcatcctcactgtaaattagagtgtctcgggctgcaaacgtgtccgatcacccgtgcctgctgcgacgacatcgccgcagcactcatcgcctgcaaaacactgaggagcctgaacctcgactggattgccttggatgctgatgcagtggtggtgctgtgtgaggcattgagccacccggactgtgccctgcagatgctgggaaattgtcagaagtccctcggagacacagttgcaccaggtgagaaccactgctctataaaacatcttctacttacgttgcccataaatatgcaacgccagctcagacttcagaag

SEQ ID NO: 159824 - DNA, 3049 bp, Homo sapiens
  Payload ID: 11264
  Gene Symbol: NMD3
  Gene Name: NMD3 ribosome export adaptor
  Uniprot ID: Q96D46
  ENST ID: ENST00000351193
  CDS Start-End: 141-1652
gcatttcgctcgcgagatcttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagccgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaa

SEQ ID NO: 159825 - DNA, 2378 bp, Homo sapiens
  Payload ID: 11264
  Gene Symbol: NMD3
  Gene Name: NMD3 ribosome export adaptor
  ENST ID: ENST00000472947
  CDS Start-End: 123-1712
cttctctgtggcggagacagccaggttggcagctgacgggacagccggggtctattttgttgcgggttttcagcaaatccagggctggtctggaggcgcgaaaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaagccaaatctgcacctgaagctgctgatttagagtcagaagtcactgaggggccaagtgtggtggttgacgcctgtaatcccagcactttgggaggctgaggagggcagatcacttcaggccaggagttcaagaccagcctggccaacatagtgaaaccctgtctctactaaaaatgcaaaaattatccgggcgtggtggtgcacacatagtcccagctactcgggacgctgaggcaggagaatcacttgaacccaggaggcagaggttgcagtgagtcgagatctggccactgtactccagcctgggcgacagagtgagactctgttcccccactcccccaataaaaaaagtctgatgagcaagaaaagttcaggggtagagttgcttgtgtaattgagatgtttaacagcatcaggctaattccttgccatagtagaacccagaagctctgagctgtgtgccaggagatacctccctggtcagtacttagtaccagagttttccctagattctttaattttagtaaatgtgctcacattgagtcaatccttacataactgggtatgttatttccagcccaaggaatgtttatttttaaaaatatttttaattatccataatttcagacttacaaaatgtcgcaagtattcccggataccatttacctagatttgccaaatgtaaacaatttgcctcatttgctttctttccccttctcactaataattttttcctcaacatttaagagtaaaatgcagacatga

SEQ ID NO: 159826 - DNA, 589 bp, Homo sapiens
  Payload ID: 11264
  Gene Symbol: NMD3
  Gene Name: NMD3 ribosome export adaptor
  ENST ID: ENST00000468606
  CDS Start-End: 296-589
cccaatccctccgacatccctgcgccggggcccttccctagcgctccgggaaagcgttcgccgcaggcctgttaggggcccaccaataccgtaacaccgttcccgtcctcttcctcggcaccgctgcaaacgccccgggtcgctacccggatttgacggtggctggagcggcacgggcgacgcaaggcagatgcggactgaattacaccgctggctttccttgttctccagcttgcaggcagcatactgtgggacttctgggcctccataattgtaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgca

SEQ ID NO: 159827 - DNA, 1077 bp, Homo sapiens
  Payload ID: 11264
  Gene Symbol: NMD3
  Gene Name: NMD3 ribosome export adaptor
  ENST ID: ENST00000463518
  CDS Start-End: 422-1077
acagccaggttggcagctgacgggacagccggggtctattttgttgcgggttttcagcaaatccagggctggtctggaggcgcgaagtaggttccggagtccgagacctgggctgtcggccgcgggcccctgagtagcggatggggcgggctccccggcctcggggccgtgctcagtctgcgtgagcgccgcgtgcccggaacccgtgtgcggtcgcgccccggggttgggggtcggcgtgggtggccctcgggcgccgggacgccgtccggagactcctgtggcgtgggtctgaggcgcggtggtccggtgcggtccctgggctggtggagagcgggagggcccgggcgtccacaatcccgagctgacctcgcccttggtcgtccagggttggagcccagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtag

SEQ ID NO: 159828 - DNA, 547 bp, Homo sapiens
  Payload ID: 11264
  Gene Symbol: NMD3
  Gene Name: NMD3 ribosome export adaptor
  ENST ID: ENST00000460503
  CDS Start-End: 81-547
caaacgccccgggtcgctacccggatttgacggtggctggagcggcacgggcgacgcaagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgt

SEQ ID NO: 159829 - DNA, 3061 bp, Homo sapiens
  Payload ID: 11264
  Gene Symbol: NMD3
  Gene Name: NMD3 ribosome export adaptor
  Uniprot ID: Q96D46
  ENST ID: ENST00000460469
  CDS Start-End: 456-1967
ggcgtgggtggccctcgggcgccgggacgccgtccggagactcctgtggcgtgggtctgaggcgcggtggtccggtgcggtccctgggctggtggagagcgggagggcccgggcgtccacaatcccgagctgacctcgcccttggtcgtccagggttggagcccaggtgagatggaggtcagcggcagagctgggtggcccgagggtcttgcagctgggaagctcaggaaatcccatggtcctcatcttaaagttctttttaacgaacttacccagtggagttgggtttccttctttcctgctttttcgaagttctgtgaatatattaattattcagagagactggaggaagacgtaaaaagaggagactaggtaaagtgatttaaatcccaacattctcttttttttttttttttttttttttttttttaaaagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcccggagacctggtgttagggtttgatttggccaactgtaacttaaatgatgagcatgtcaacaaaatgaactcagatagagttccagatgtggtattaatcaagaagagctatgaccggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagccgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaag

SEQ ID NO: 159830 - DNA, 746 bp, Homo sapiens
  Payload ID: 11264
  Gene Symbol: NMD3
  Gene Name: NMD3 ribosome export adaptor
  ENST ID: ENST00000493066
  CDS Start-End: 91-746
atacgtcactcgggccgcgggatttcgagcatttcgctcgcgagatcttctctgtggcggagacagccagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtag

SEQ ID NO: 159831 - DNA, 685 bp, Homo sapiens
  Payload ID: 11264
  Gene Symbol: NMD3
  Gene Name: NMD3 ribosome export adaptor
  ENST ID: ENST00000476237
  CDS Start-End: 200-685
tcggcgtgggtggccctcgggcgccgggacgccgtccggagactcctgtggcgtgggtctgaggcgcggtggtccggtgcggtccctgggctggtggagagcgggagggcccgggcgtccacaatcccgagctgacctcgcccttggtcgtccagggttggagcccaggtgagatggagaacttaaggcatacagaacgatggagtatatggcagaatccaccgaccgcagccctggacacatcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaag

SEQ ID NO: 159832 - DNA, 3640 bp, Homo sapiens
  Payload ID: 11265
  Gene Symbol: NSMF
  Gene Name: NMDA receptor synaptonuclear signaling and neuronal migration factor
  Uniprot ID: Q6X4W1
  ENST ID: ENST00000265663
  CDS Start-End: 233-1819
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 159833 - DNA, 2914 bp, Homo sapiens
  Payload ID: 11265
  Gene Symbol: NSMF
  Gene Name: NMDA receptor synaptonuclear signaling and neuronal migration factor
  ENST ID: ENST00000339554
  CDS Start-End: 107-1090
gtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaataccaaa

SEQ ID NO: 159834 - DNA, 672 bp, Homo sapiens
  Payload ID: 11265
  Gene Symbol: NSMF
  Gene Name: NMDA receptor synaptonuclear signaling and neuronal migration factor
  ENST ID: ENST00000371468
  CDS Start-End: 72-509
tgccgtcaccctctcacggccctcttcagcccctggcttcctcccccaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgtgagtcccgccccgggcctgcccccaacagatgccctcttgcggccccaccctgggccagcgccggcaccccaggtccccagggtgctgtggcgctgctggctctgacgcagccttgatgtggccttgtggcctgtgtctgtccccaggaccatgagcacgcaaccttcgaggacatccttggtatgtgcctcattggccttctctctgctggttccaggcctgggaggggcagacacaggtgggggtgcccctggggctggggtggggg

SEQ ID NO: 159835 - DNA, 1852 bp, Homo sapiens
  Payload ID: 11265
  Gene Symbol: NSMF
  Gene Name: NMDA receptor synaptonuclear signaling and neuronal migration factor
  Uniprot ID: Q6X4W1
  ENST ID: ENST00000371472
  CDS Start-End: 201-1787
acgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggccgggcttggaacgatgtacgataccctcatagtgaccattaaacctgatcctccaccgcg

SEQ ID NO: 159836 - DNA, 3556 bp, Homo sapiens
  Payload ID: 11265
  Gene Symbol: NSMF
  Gene Name: NMDA receptor synaptonuclear signaling and neuronal migration factor
  Uniprot ID: Q6X4W1
  ENST ID: ENST00000371473
  CDS Start-End: 233-1735
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 159837 - DNA, 3571 bp, Homo sapiens
  Payload ID: 11265
  Gene Symbol: NSMF
  Gene Name: NMDA receptor synaptonuclear signaling and neuronal migration factor
  Uniprot ID: Q6X4W1
  ENST ID: ENST00000371474
  CDS Start-End: 233-1750
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagcgaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 159838 - DNA, 3646 bp, Homo sapiens
  Payload ID: 11265
  Gene Symbol: NSMF
  Gene Name: NMDA receptor synaptonuclear signaling and neuronal migration factor
  Uniprot ID: Q6X4W1
  ENST ID: ENST00000371475
  CDS Start-End: 233-1825
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcggtgttcaggggctacgcggagaggaagcgccggaaacgggagaatgattccgcgtctgtaatccagaggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 159839 - DNA, 2888 bp, Homo sapiens
  Payload ID: 11265
  Gene Symbol: NSMF
  Gene Name: NMDA receptor synaptonuclear signaling and neuronal migration factor
  ENST ID: ENST00000371482
  CDS Start-End: 1135-1719
tctggagttgaaggggagccctggaaggctgtcgcgggaagagcactgggtgggatttgcctttgggtgggaggtggtgccaggagccagggagagcactggcttcccacaccgaaggggaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagtaggtgccccgcacaggcccgcccaccttccccagagcctcccctagaccccagacccctgctgggggtcccctgccagggccgctgggctgcgcttttgcactcctgaatcttggtttacctgtttgtgagatggggacgccctcagcatctccgatcgcaaaggcggggctaacaacggccgcggcagtgctggccgggggcgcctgtagggccgtgcccaccgccactcgcaagaggccctcaggggcagggggctgcggtgcccgcccccactccctcccaggcgcccggcggacttggctggagctgatgcctgcacgcgccttccaccggcctcgcaccagggtctcccttcccacatcaggccgctgcccagtggtgtccacaggcctgtcctgccgggctggcggcgacctctgtatggtcctcccacttgcttggaggaccctccgggatggggctttcgggccctgtgggccttggggccatggccaggataggaggtgctgccgggcctgctgtcctggtgaccctcttgcttcccaggcagtgacctgcagagctcccactgcacgctggacgaggccttcgaggacctggactgggacactgagaagggcctggaggctgtggcctgcgacaccgaaggcttcgtgccaccaaaggtcatggtgaggcccagcccgggcagtgctcctctacaccccgagcaggactccgccccaacccgagtccagccagctctgcctgggaccacgcagccttctccagctgcctgggggagggtgtctcacagggctatacccttgggctgcctggcagccagaaggtagcctcatgggggctcccacagccccttggcttttggatgggcctggggcccctgagcagctctttgtctccgcagctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcg

SEQ ID NO: 159840 - DNA, 3577 bp, Homo sapiens
  Payload ID: 11265
  Gene Symbol: NSMF
  Gene Name: NMDA receptor synaptonuclear signaling and neuronal migration factor
  Uniprot ID: Q6X4W1
  ENST ID: ENST00000437259
  CDS Start-End: 233-1756
ggttcgggcagcgctctcccgggagcggcggcacgcgcggagcgccgggtgcggccatgcggggaccgggcccgaccccgagcccgaccccgagcccaagcccgagccggagcccgagcgagaccccgagcccgagcccgagcgcgacccccggtgcggcgcggctaccccggcggaggcggcgggcgcggggcgcgctctgaggcccgggggatgcgccgccgcctcgaccatgggcgccgccgcctccaggaggagggcgctgaggagcgaggccatgtcctcggtggcggccaaagtgcgagcagcccgagcgtttggagagtacctgtcccagagtcaccctgagaaccgcaacggcgcagatcacctgctggctgatgcctactctggccacgacgggtcccccgagatgcagccggccccccagaacaagcgccgcctgtccctcgtctccaacggctgctacgagggcagcctctcagaggagcccagcattaggaagcccgcaggcgagggccctcagcctcgagtgtacaccatctctggggagcctgccctgctgcccagccctgaggcggaggccattgagctggcggtggtgaaggggcggcggcagcggcaccctcaccatcacagccagcccctgcgcgccagccctggtggcagccgggaggacgtcagcaggccctgccagagctgggcgggcagccgccagggctccaaggagtgccccggatgtgcccagctggctcctggccccacccctcgggcctttgggctggaccagccacctctgcctgagacctccggtcgccgcaagaagctggagaggatgtacagcgttgaccgtgtgtctgacgacatccctattcgtacctggttccccaaggaaaatcttttcagcttccagacagcaaccacaactatgcaagccatctcgaacttccgcaaacacctgcgcatggtcggcagccggagggtgaaggcccagacgttcgctgagcggcgcgagcggagcttcagccggtcctggagcgaccccacccccatgaaagccgacacttcccacgactcccgagacagcagtgacctgcagagctcccactgcacgctggacgaggccttcgaggacctggactgggacactgagaagggcctggaggctgtggcctgcgacaccgaaggcttcgtgccaccaaaggtcatgctcatttcctccaaggtgcccaaggctgagtacatccccactatcatccgccgggatgacccctccatcatccccatcctctacgaccatgagcacgcaaccttcgaggacatccttgaggagatagagaggaagctgaacgtctaccacaagggagccaagatctggaaaatgctgattttctgccagggaggtcctggacacctctatctcctcaagaacaaggtggccacctttgccaaagtggagaaggaagaggacatgattcacttctggaagcggctgagccgcctgatgagcaaagtgaacccagagccgaacgtcatccacatcatgggctgctacattctggggaaccccaatggagagaagctgttccagaacctcaggaccctcatgactccttatagggtcaccttcgagtcacccctggagctctcagcccaagggaagcagatgatcgagacgtactttgacttccggttgtatcgcctgtggaagagccgccagcactcgaagctgctggactttgacgacgtcctgtgaggggcagaggcctccgcccagtcaccatcaggccactccctctgcaccgggacctggggctgggccgcctcgtgctccccgggactgtgtggctccggtctcgcctggagccacttcagggcacctcagacgttgctcaggttccccctgtgggttccggtcctcgctgcacccgtggccgcagaggctgcagtccctgggggccgggaggatcccgccctgtggcccgtggatgctcagcggccaggcactgacctgccatgcctcgcctggaggctcagctgtgggcatccctccatggggttcatagaaataagtgcaatttctacacccccgaaacaattcaaagggaagcagcatttcttgttaactagttaagcactatgctgctagttacagtgtaggcaccccggcccagcagcccagcagcccacatgtgttcaggaccctccctgcccaccccctccctgccgtatcgatcaccagcaccagggtggcccgtgtgcgtggggccagcgtcgccgggctgcccagcctggctctgtctacactggccgagtctctgggtctgtctacactggccgagtctccgactgtctgtgctttcacttacactcctcttgccaccccccatccctgcttacttagacctcagccggcgccggacccggtaggggcagtctgggcagcaggaaggaagggcgcagcgtcccctccttcagaggaggctctgggtggggcctgctccccatccccccaagcccacccagcactctcattgctgctgttgagttcagcttttaccagcctcagtgtggaggctccatcccagcacacaggcctggggcttggcaggggcccagctggggctgggccctgggttttgagaaactcgctggcaccacagtgggcccctggacccggccgcgcagctggtggactgtaggggctcctgactgggcacaggagctcccagcttttgtccacggccagcaggatgggctgtcgtgtatatagctggggcgagggggcaggccccccttgtgcagagccaggggtctgagggcacctggctgtgttcccagctgagggagggctggggcgggggccgggcttggaacgatgtacgataccctcatagtgaccattaaacctgatcctccaccgcggccgccgcgtgggtctgtcctctcagtgctttccaggggccttcctgtgcccagcttctgggcccactcctgtgaggtcactgctgcagggccttcctgcctggacagagttggagctaggccactagaccaccccacagggcatagccagggggaccagcacaggaggggacggagaggagctgcaggagggctggggggaggctgcagtctcggaggggggcctcgccgggtctggaggggacagcagagacagcccgttccccctgccgcctgagggcaccagggagagggctgtatgtccctcacgccacactgtgtgtgcagtcagcagtgtggccacagatgggggccactctctcaacctcaggtgtcctcagggcccagaccgctgctgggcacagccaggctggctgccagctggttccctgccccgtggctgggggacagagcagcacgtatcagctgggctagggtcagggggccactggtgcgcagcctggcacagcctggcaggcttgaggcccagtgtgctgggggtggtcacacagccgtcagccacctccagctcttccagggcattctagatggggtcccgggagggggcaggttttggtgccaatttgagtgtataaagttttaggtaaatacc

SEQ ID NO: 159841 - DNA, 1198 bp, Homo sapiens
  Payload ID: 11266
  Gene Symbol: NME5
  Gene Name: NME/NM23 family member 5
  Uniprot ID: P56597
  ENST ID: ENST00000265191
  CDS Start-End: 51-689
aggtctcctagcaacaagttgtaccatatgaggacggccgctgagccataatggagatatcaatgcctccacctcagatatatgtagaaaaaactctggccattatcaaaccagatattgttgacaaagaggaggagatacaagatattattcttagatccggattcaccattgttcagagaagaaaactacgcctcagccctgagcaatgtagtaacttttatgtggaaaagtatggaaaaatgtttttccccaacttaacagcttacatgagttctggaccacttgtcgccatgatattagctagacataaagccatctcttattggttagaacttttgggaccaaataatagcttagtagcgaaggagacacatccagacagtctgagggcaatttatggcacagatgacctaaggaatgcacttcatgggagtaatgactttgctgctgcggaaagagaaatacgttttatgtttcctgaagtgattgttgagcccattccaattggacaagctgctaaggactatttaaatttacatataatgccaactctgcttgaaggactcacagagctttgtaagcaaaaaccagcagatcctttgatttggctagctgattggctgctgaaaaataatcctaacaaacccaaactttgtcaccatccaattgtagaagaaccttattaaaaaaaaaatcctcgaaagaacaaatcatgaactatcttattataaaaggctgtacttctactgtttgaaaaaattatttctagggtttaagtaactacaagtaaaataaatttatttcttaaaaataagtgttaaaggaataactattctatgaagcagataacattaaggtaaaatataggcttagagtatgattttaacaatgatgtaacactaggtaatggaaaactcatgtaagatgttgctagatgtttttgtttttcttaagtttgagaagtaagacataaagtttagttatacattttcccaagcacatatcctatatctaaatacataattaatgcacagttgagacagtctagtttaaaaggcttaggtccttttgtagtccataagcatggtgatttggtttcatgctcatgtgtcagatatgcttccctcaaaccttgttacagcatcatcacattacctgtttgatgtaaaaaataaaaaatagaaaggtgtaagta

SEQ ID NO: 159842 - DNA, 1642 bp, Homo sapiens
  Payload ID: 11267
  Gene Symbol: NME7
  Gene Name: NME/NM23 family member 7
  Uniprot ID: Q9Y5B8
  ENST ID: ENST00000367811
  CDS Start-End: 258-1388
ggaagtaaaactgccggaaacagaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaa

SEQ ID NO: 159843 - DNA, 1678 bp, Homo sapiens
  Payload ID: 11267
  Gene Symbol: NME7
  Gene Name: NME/NM23 family member 7
  ENST ID: ENST00000525440
  CDS Start-End: 237-1256
agaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctacccccaaatctccaatttctcacaagtgaatttaggcaaactaaagaagacatctctgttccgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttc

SEQ ID NO: 159844 - DNA, 1087 bp, Homo sapiens
  Payload ID: 11267
  Gene Symbol: NME7
  Gene Name: NME/NM23 family member 7
  ENST ID: ENST00000528517
  CDS Start-End: 21-791
agtgctgagatcctgagacaatgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaagtgaggaggaacccctgactactctttcctggaaatcttcattcccataggtcttctctgctgtccctatgatggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgtaa

SEQ ID NO: 159845 - DNA, 1590 bp, Homo sapiens
  Payload ID: 11267
  Gene Symbol: NME7
  Gene Name: NME/NM23 family member 7
  Uniprot ID: Q9Y5B8
  ENST ID: ENST00000472647
  CDS Start-End: 314-1336
agaataatggcgtctcgtagccccaggcgacagcgtggaggggcgggtctgtcgattggatgaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacaatgagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaa

SEQ ID NO: 159846 - DNA, 2312 bp, Homo sapiens
  Payload ID: 11268
  Gene Symbol: NME8
  Gene Name: NME/NM23 family member 8
  Uniprot ID: Q8N427
  ENST ID: ENST00000199447
  CDS Start-End: 373-2139
ggagtttggggatgaggcagctgaagaacagagtcttgtgatggtggaaccaggacttcgttgttccttcattgtgtgggcagaagaggtggaggattttaggcgccacctggtcttgtccccactgcccagacaggcagggaatccctcttcttccttttgctgaatcagctggagaagaaagcccagcaggaggcctgctagcctcagcctcgggccctaccagggtcctaggtactggaatggaacttcgccgaggtcaccgctcaaacggccacaacgagggagccgatttagatcctctgggcctgttccttccttttctttaaacgtcccagtctagcttagaggaggacctgttttgttagataaatggcaagcaaaaaacgagaagtccagttacagacagtcatcaataatcaaagcctgtgggatgagatgttgcagaacaaaggcttaacagtgattgatgtttaccaagcctggtgtggaccttgcagagcaatgcaacctttattcagaaaattgaaaaatgaactgaacgaagacgaaattctgcattttgctgtcgcagaagctgacaacattgtgactttgcagccatttagagataaatgtgaacctgtttttctctttagtgttaatggcaaaattatcgaaaagattcagggtgcaaatgcaccgcttgttaataaaaaagttattaatttgatcgatgaggagagaaaaattgcagcaggtgaaatggctcgacctcagtatcctgaaattccattagtagactcagattcagaagttagtgaagaatcaccatgtgaaagtgttcaggaattatacagtattgctattatcaaaccggatgctgtgattagtaaaaaagttctagaaattaaaagaaaaattaccaaagctggatttattatagaagcagagcataagacagtgctcactgaagaacaagttgtcaacttctatagtcgaatagcagaccagtgtgacttcgaagagtttgtctcttttatgacaagtggcttaagctatattctagttgtatctcaaggaagtaaacacaatcctccctctgaagaaaccgaaccacagactgacaccgaacctaacgaacgatctgaggatcaacctgaggtcgaagcccaggttacacctggaatgatgaagaacaaacaagacagtttacaagaatatctggaaagacaacatttagctcagctctgtgacattgaagaggatgcagctaatgttgctaagttcatggatgctttcttccccgattttaaaaaaatgaaaagcatgaaattagaaaagacattggcattacttcgaccaaatctctttcatgaaaggaaagatgatgttttgcgtattattaaagatgaagacttcaaaatactggagcaaagacaagtagtattatcggaaaaagaagcacaagcactgtgcaaggaatatgaaaatgaagactattttaataaacttatagaaaacatgaccagtggtccatctctagcccttgttttattgagagacaatggcttgcaatactggaaacaattactgggaccaagaactgttgaagaagccattgaatattttccagagagtttatgtgcacagtttgcgatggacagtttgccggtcaaccagttgtatggcagcgattcattagaaaccgctgaaagggaaatacagcatttctttcctcttcaaagcactttaggcttgattaaacctcatgcaacaagtgaacaaagagagcagatcctgaagatagttaaggaggctggatttgatctgacacaggtgaagaaaatgttcctaactcctgagcaaatagagaaaatttatccaaaagtaacaggaaaagacttttataaagatttattggaaatgttatctgtgggtccatctatggtcatgattctgaccaagtggaatgctgttgcagaatggagacgattgatgggcccaacagacccagaagaagcaaaattactttcccctgactccatccgagcccagtttggaataagtaaattgaaaaacattgtccatggagcatctaacgcctatgaagcaaaagaggttgttaatagactctttgaggatcctgaggaaaactaaagtatatactgtgaaaactttgagaagataatacatatgttcacgtcaatatacaaccatttggcacagcttcctgggaggaataataagaaaaacatgctttggaggaaaactcaagatacaaaaatgaatggctatgcataataacaataaaaatgtattccccaaacaaa

SEQ ID NO: 159847 - DNA, 473 bp, Homo sapiens
  Payload ID: 11268
  Gene Symbol: NME8
  Gene Name: NME/NM23 family member 8
  ENST ID: ENST00000455500
  CDS Start-End: 127-473
gaggcagctgaagaacagagtcttgtgatggtggaaccaggacttcgttgttccttcattgtgtgggcagaagaggtggaggattttaggcgccacctggtcttgtccccactgcccagtagataaatggcaagcaaaaaacgagaagtccagttacaggcagaagctgacaacattgtgactttgcagccatttagagataaatgtgaacctgtttttctctttagtgttaatggcaaaattatcgaaaagattcagggtgcaaatgcaccgcttgttaataaaaaagttattaatttgatcgatgaggagagaaaaattgcagcaggtgaaatggctcgacctcagtatcctgaaattccattagtagactcagattcagaagttagtgaagaatcaccatgtgaaagtgttcaggaattatacagtattgctattatcaaaccggatgctgtgattagtaaaaaagttct

SEQ ID NO: 159848 - DNA, 561 bp, Homo sapiens
  Payload ID: 11268
  Gene Symbol: NME8
  Gene Name: NME/NM23 family member 8
  ENST ID: ENST00000444718
  CDS Start-End: 112-561
accgctcaaacggccacaacgagggagccgatttagatcctctgggcctgttccttccttttctttaaacgtcccagtctagcttagaggaggacctgttttgttagataaatggcaagcaaaaaacgagaagtccagttacaggcagaagctgacaacattgtgactttgcagccatttagagataaatgtgaacctgtttttctctttagtgttaatggcaaaattatcgaaaagattcagggtgcaaatgcaccgcttgttaataaaaaagttattaatttgatcgatgaggagagaaaaattgcagcaggtgaaatggctcgacctcagtatcctgaaattccattagtagactcagattcagaagttagtgaagaatcaccatgtgaaagtgttcaggaattatacagtattgctattatcaaaccggatgctgtgattagtaaaaaagttctagaaattaaaagaaaaattaccaaagctggatttattatagaagcagagcataagacagtgctcactgaagaacaagttgtcaacttctatagtcgaatagca

SEQ ID NO: 159849 - DNA, 1879 bp, Homo sapiens
  Payload ID: 11268
  Gene Symbol: NME8
  Gene Name: NME/NM23 family member 8
  Uniprot ID: Q8N427
  ENST ID: ENST00000440017
  CDS Start-End: 113-1879
aaacgtcccagtctagcttagaggaggacctgttttgtgtaaggcttgccggagcaaccagcacctttcctggaatacagtcttgtttgtggcttttcctttgtttagataaatggcaagcaaaaaacgagaagtccagttacagacagtcatcaataatcaaagcctgtgggatgagatgttgcagaacaaaggcttaacagtgattgatgtttaccaagcctggtgtggaccttgcagagcaatgcaacctttattcagaaaattgaaaaatgaactgaacgaagacgaaattctgcattttgctgtcgcagaagctgacaacattgtgactttgcagccatttagagataaatgtgaacctgtttttctctttagtgttaatggcaaaattatcgaaaagattcagggtgcaaatgcaccgcttgttaataaaaaagttattaatttgatcgatgaggagagaaaaattgcagcaggtgaaatggctcgacctcagtatcctgaaattccattagtagactcagattcagaagttagtgaagaatcaccatgtgaaagtgttcaggaattatacagtattgctattatcaaaccggatgctgtgattagtaaaaaagttctagaaattaaaagaaaaattaccaaagctggatttattatagaagcagagcataagacagtgctcactgaagaacaagttgtcaacttctatagtcgaatagcagaccagtgtgacttcgaagagtttgtctcttttatgacaagtggcttaagctatattctagttgtatctcaaggaagtaaacacaatcctccctctgaagaaaccgaaccacagactgacaccgaacctaacgaacgatctgaggatcaacctgaggtcgaagcccaggttacacctggaatgatgaagaacaaacaagacagtttacaagaatatctggaaagacaacatttagctcagctctgtgacattgaagaggatgcagctaatgttgctaagttcatggatgctttcttccccgattttaaaaaaatgaaaagcatgaaattagaaaagacattggcattacttcgaccaaatctctttcatgaaaggaaagatgatgttttgcgtattattaaagatgaagacttcaaaatactggagcaaagacaagtagtattatcggaaaaagaagcacaagcactgtgcaaggaatatgaaaatgaagactattttaataaacttatagaaaacatgaccagtggtccatctctagcccttgttttattgagagacaatggcttgcaatactggaaacaattactgggaccaagaactgttgaagaagccattgaatattttccagagagtttatgtgcacagtttgcgatggacagtttgccggtcaaccagttgtatggcagcgattcattagaaaccgctgaaagggaaatacagcatttctttcctcttcaaagcactttaggcttgattaaacctcatgcaacaagtgaacaaagagagcagatcctgaagatagttaaggaggctggatttgatctgacacaggtgaagaaaatgttcctaactcctgagcaaatagagaaaatttatccaaaagtaacaggaaaagacttttataaagatttattggaaatgttatctgtgggtccatctatggtcatgattctgaccaagtggaatgctgttgcagaatggagacgattgatgggcccaacagacccagaagaagcaaaattactttcccctgactccatccgagcccagtttggaataagtaaattgaaaaacattgtccatggagcatctaacgcctatgaagcaaaagaggttgttaatagactctttgaggatcctgaggaaaactaa

SEQ ID NO: 159850 - DNA, 495 bp, Homo sapiens
  Payload ID: 11268
  Gene Symbol: NME8
  Gene Name: NME/NM23 family member 8
  ENST ID: ENST00000426106
  CDS Start-End: 15-179
atgatagtagataaatggcaagcaaaaaacgagaagtccagttacaggcagaagctgacaacattgtgactttgcagccatttagagataaatgtgaacctgtttttctctttagtgttatgatgttttgcgtattattaaagatgaagacttcaaaatactggagcaaagacaagtagtattatcggaaaaagaagcacaagcactgtgcaaggaatatgaaaatgaagactattttaataaacttatagaaaacatgaccagtggtccatctctagcccttgttttattgagagacaatggcttgcaatactggaaacaattactgggaccaagaactgttgaagaagccattgaatattttccagagagtttatgtgcacagtttgcgatggacagtttgccggtcaaccagttgtatggcagcgattcattagaaaccgctgaaagggaaatacagcatttctttcctcttcaaagcactttaggcttgat

SEQ ID NO: 159851 - DNA, 1930 bp, Homo sapiens
  Payload ID: 11269
  Gene Symbol: NME9
  Gene Name: NME/NM23 family member 9
  Uniprot ID: Q86XW9
  ENST ID: ENST00000317876
  CDS Start-End: 36-827
aggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggtgagtccagtacacagccaaggttgaagatcactgacctagactaaaatgagaggattcagaagtctgaccttagaacatgagagagtggaaaacctcaggatgtttcagccaaacaagaagagaagaaaatattgttgaaattaacaatgatcagggaaaatatcatctattaagaacagggaaccacattttagctgtagattaggaatggtaatttttatctggtgttttagtttccaaaacatttacatattgatctactcctcgccctagaccaaacctaattccattcttactgatatgcacaatcactctctgtcctcattgtcacctctagcccctaaattcctccctttctcagtctacctactctttgtgactccctcatatcttttccccctggcatggatgtcctgctcagacactccacttagaagacagtttccctttttcactgtcctcccaccattcattactcctcctccagataccaactgctgatgttgctctagaaaaaccaccaaacatgactgttctttccgtgtaagctatcccacctcagcggcaccctcactgctggtgaccagccttgtaaccccctggagatgcccatgttccttatggtagctacctcttacttcaaattcttctgcctccctcatgctcgcagccactctgtgcccacctcatcttcgtagggaccttgattttggggacacacattgcaacttcccacttctgacgaaaggtctccatgcttttgctgttttctttactcttgtcaaggttgggtacttcaagctcaaagcctatctaccttgatccaaaaactacctttccataatgttctcacatctttactctgtcctacctctcattttcaatcctgtttaaaagacgtttaagtgtccaaactttaacctcttgaagctagtcctctccccactttccatctttaaatgggcatatatacaataaaggctctgtccatctccatctcttatatataacaatactgtgacttaaaaaccaactcagtattggaaattttctaaagttctgtcctagagttctttcctgacctctagctccatacttctgattgcctaataaatatgacatggatgttcagtggaacttcccatct

SEQ ID NO: 159852 - DNA, 1281 bp, Homo sapiens
  Payload ID: 11269
  Gene Symbol: NME9
  Gene Name: NME/NM23 family member 9
  Uniprot ID: Q86XW9
  ENST ID: ENST00000333911
  CDS Start-End: 29-1021
aacagggcttcgtcttctttgcagagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaggaggagaactggtggctgtggttagaggagcaaatgccccactgctgcagaaaaccatcctagaccagctggaggccgaaaagaaagtgctggctgaaggcagagaacggaaagtgattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggcggtgaggctgaagcaacagcggggcccactgaggcgctttgctttcctgaggatgtggattgagatggctgtgctgctcttccagagcacgtgaccaggggtctactgcacaaaacagacctccggaatcggaacttactcttttgagtaccaatactttttggtttagctgtcttttgtagacaatgaaaataatatggctgggcgcagtgactcacacctgtaatcccagcactttgggaggccgaggcaggtggatcacctgagattaggagtttgacaccagcctagccaacatggtgaaaccctgtctctactaaaaa

SEQ ID NO: 159853 - DNA, 2133 bp, Homo sapiens
  Payload ID: 11269
  Gene Symbol: NME9
  Gene Name: NME/NM23 family member 9
  Uniprot ID: Q86XW9
  ENST ID: ENST00000383180
  CDS Start-End: 239-1030
ggctttcctggcaggcctggcgggggggccaggttgccatgacgaccgcggctaggtcgcggcagactcgagccatgggcagcaggaagaaggaaattgccctgcaggctggaatgcagcggcatgatctcatctcagtgcaacctccacctctcacgttcaagcagttctcatgtctcagcctcccgagtagctggtaaaacaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggtgagtccagtacacagccaaggttgaagatcactgacctagactaaaatgagaggattcagaagtctgaccttagaacatgagagagtggaaaacctcaggatgtttcagccaaacaagaagagaagaaaatattgttgaaattaacaatgatcagggaaaatatcatctattaagaacagggaaccacattttagctgtagattaggaatggtaatttttatctggtgttttagtttccaaaacatttacatattgatctactcctcgccctagaccaaacctaattccattcttactgatatgcacaatcactctctgtcctcattgtcacctctagcccctaaattcctccctttctcagtctacctactctttgtgactccctcatatcttttccccctggcatggatgtcctgctcagacactccacttagaagacagtttccctttttcactgtcctcccaccattcattactcctcctccagataccaactgctgatgttgctctagaaaaaccaccaaacatgactgttctttccgtgtaagctatcccacctcagcggcaccctcactgctggtgaccagccttgtaaccccctggagatgcccatgttccttatggtagctacctcttacttcaaattcttctgcctccctcatgctcgcagccactctgtgcccacctcatcttcgtagggaccttgattttggggacacacattgcaacttcccacttctgacgaaaggtctccatgcttttgctgttttctttactcttgtcaaggttgggtacttcaagctcaaagcctatctaccttgatccaaaaactacctttccataatgttctcacatctttactctgtcctacctctcattttcaatcctgtttaaaagacgtttaagtgtccaaactttaacctcttgaagctagtcctctccccactttccatctttaaatgggcatatatacaataaaggctctgtccatctccatctcttatatataacaatactgtgacttaaaaaccaactcagtattggaaattttctaaagttctgtcctagagttctttcctgacctctagctccatacttctgattgcctaataaatatgacatggatgttcagtggaacttcccatct

SEQ ID NO: 159854 - DNA, 660 bp, Homo sapiens
  Payload ID: 11269
  Gene Symbol: NME9
  Gene Name: NME/NM23 family member 9
  ENST ID: ENST00000475751
  CDS Start-End: 55-660
gggcgcgtcgaagatcttgtacctgtcgttcgcagtggctcactttcccaagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaggaggagaactggtggctgtggttagaggagcaaatgccccactgctgcagaaaaccatcctagaccagctggaggccgaaaagaaagtgctggctgaaggcagagaacggaaagtgattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtg

SEQ ID NO: 159855 - DNA, 1118 bp, Homo sapiens
  Payload ID: 11269
  Gene Symbol: NME9
  Gene Name: NME/NM23 family member 9
  ENST ID: ENST00000492993
  CDS Start-End: 33-557
tcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagagtctccgagctcagtacggcacagaaatgcccttcaatgccgtccatggaagccgggacagagaagatgctgacagagaactggcattgctcttccccagtttgaaattttcagacaaagatacagaagcccctcagggtgagtccagtacacagccaaggttgaagatcactgacctagactaaaatgagaggattcagaagtctgaccttagaacatgagagagtggaaaacctcaggatgtttcagccaaacaagaagagaagaaaatattgttgaaattaacaatgatcagggaaaatatcatctattaagaacagggaaccacattttagctgtagattaggaatggtaatttttatctggtgttttagtttccaaaacatttacatattgatctactcctcgccctagaccaaacctaattccattcttactgatatgcacaatcactctctgtcctcattgtcacctctagcccctaaattcctccctttctcagtctacctactctttgtgactccctcatatcttttccccctggcatggatgtcctgctcagacactccacttagaagacagtttccctttttcactgtcctcccaccattcattactcctcctccagatacca

SEQ ID NO: 159856 - DNA, 825 bp, Homo sapiens
  Payload ID: 11269
  Gene Symbol: NME9
  Gene Name: NME/NM23 family member 9
  Uniprot ID: Q86XW9
  ENST ID: ENST00000484930
  CDS Start-End: 40-825
cttgtacctgtcgttcgcagtggctcactttcccaagccatgggcagcaggaagaaggaaattgccctgcaggtcaacatcagcacccaagagctttgggaggaaatgctcagttccaaaggactaactgttgttgatgtctatcaaggctggtgtggcccctgcaaacctgtggtgagcctcttccagaagatgaggatcgaggtcggcctggaccttctgcactttgcattaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagaggaggcatttgagaagctggtacatcacatgtgcagtggaccaagccacctcctgatcctcaccaggactgagggcttcgaggacgtggtcactacctggcgaaccgtcatgggcccccgtgaccccaatgtggccaggagggagcagccagaaagtctccgagctcagtacggcacagaaatgcccttcaatgccgtccatggaagccgggacagagaagatgctgacagagaactggcattgctcttccccagtttgaaattttcagacaaagatacagaagcccctcagggtgagtccagtacacagccaaggttgaagatcactgacctagactaa

SEQ ID NO: 159857 - DNA, 579 bp, Homo sapiens
  Payload ID: 11269
  Gene Symbol: NME9
  Gene Name: NME/NM23 family member 9
  ENST ID: ENST00000460099
  CDS Start-End: 489-579
agactcggttggtgactccgggcgcgtcgaagatcttgtacctgtcgttcgcagtggctcactttcccagtaatccataagaacagcagggataacagggtcccatgtcgtttttttgtcagaattcctcgactggcgaccctgtgcccgacaggctgcaccgcgcccggcgcactgactccggcctctgcgcgcgccccctggccggctccggggtggggagggggcttcgcagatccccagaaaaccgcccggcgagccacgagcccgtggactgcaggctccgcttcctcgcggggtgttcactttgtatcagtgtgctgatttgccgccagttagaagcaccttaaaaaggggccgggggccgtaggaggggggcttgtctgaaggaggctctgggcttgctgatccacgcagcggtttgtcgcgaggctgcgggggaacggcccacggccgcggtaacagggcttcgtcttctttgcagagccatgggcagcaggaagaaggaaattgccctgcaggtcaacatcagcacccaagagctttgggaggaaatgctcagttccaaaggactaactg

SEQ ID NO: 159858 - DNA, 800 bp, Homo sapiens
  Payload ID: 11269
  Gene Symbol: NME9
  Gene Name: NME/NM23 family member 9
  ENST ID: ENST00000474690
  CDS Start-End: 1-499
tgttgatgtctatcaaggctggtgtggcccctgcaaacctgtggtgagcctcttccagaagatgaggatcgaggtcggcctggaccttctgcactttgcattagcagaggcagatcgtcttgatgtcctcgaaaagtacagagggaagtgcgagccaacctttctgttttatgcaattaaagatgaggctctttctgatgaagatgaatgtgtttcccatggaaagaataatggtgaagatgaggacatggtttcatcagagaggacctgtaccttggccatcattaaaccagatgcagtggcccatggaaagactgatgagattatcatgaagattcaggaagctgggtttgaaattctaacaaatgaagagagaaccatgacagaggcagaagtgcgacttttctaccaacacaaagctggagagtctccgagctcagtacggcacagaaatgcccttcaatgccgtccatggaagccgggacagagaagatgctgacagagaactggcattgctcttccccagtttgaaattttcagacaaagatacagaagcccctcagggtaagtcatcaaggcagacttggtctttattaaatcatagatacaaggaatttgtaactatgtgcttgagtgtgtgggggattgataatttttggtaactaagtcttcaacctaatacagtcctgttctgaaaatacaggtcattatataacttgattatcaatactaaactgttttgtgttctcatagagcaacagtgttgctttttaatacctcattaaattttttgctgctta

SEQ ID NO: 159859 - DNA, 688 bp, Homo sapiens
  Payload ID: 11269
  Gene Symbol: NME9
  Gene Name: NME/NM23 family member 9
  ENST ID: ENST00000488716
  CDS Start-End: 74-343
agactcggttggtgactccgggcgcgtcgaagatcttgtacctgtcgttcgcagtggctcactttcccaagccatgggcagcaggaagaaggaaattgccctgcaggtcaacatcagcacccaagagctttgggaggaaatgctcagttccaaaggactaactggcactaaaggagaatgcattggaaggaatacagggatctcttggaactcaaaggatggaaggagagccaggcatcactgggacttgaacctgggactgcagtcattaggaaacagcaggccactgtctatgggcctcctcatccctatcctcctggcatcagttatttgttgcacttagcaatttacccagaaacttagtgctttacaacaacaaacattgattatcccagtttctgtgggtcaggagtccaggtatagcttagttggatacctctggctcagagtgtctcaccacggtagttaaggtatcagacgggatctcaaggctcaacgaggagcagatttgcttccaagttcttttgtgtggctgttggcagacctaagaagatccacttccaagctcactcatgaggctgtggttgttgatgtctatcaaggctggtgtggcccctgcaaacctgtggtgagcctcttccagaagatgaggatcgaggtcggcctggaccttctgcactttgcatta

SEQ ID NO: 159860 - DNA, 796 bp, Homo sapiens
  Payload ID: 11270
  Gene Symbol: NME1
  Gene Name: NME/NM23 nucleoside diphosphate kinase 1
  Uniprot ID: P15531
  ENST ID: ENST00000013034
  CDS Start-End: 210-743
aagaggtgttcgggatcctgagaggaaaaagaaaggagtgtagtcgcgggagtgggttaggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatggg

SEQ ID NO: 159861 - DNA, 986 bp, Homo sapiens
  Payload ID: 11270
  Gene Symbol: NME1
  Gene Name: NME/NM23 nucleoside diphosphate kinase 1
  Uniprot ID: P15531
  ENST ID: ENST00000336097
  CDS Start-End: 237-770
gtgcaagtgctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttca

SEQ ID NO: 159862 - DNA, 940 bp, Homo sapiens
  Payload ID: 11270
  Gene Symbol: NME1
  Gene Name: NME/NM23 nucleoside diphosphate kinase 1
  Uniprot ID: P15531
  ENST ID: ENST00000393196
  CDS Start-End: 132-590
gggctctccggcagcggatctgcgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttcttttcatgtacactgaataacctgacctaatagagagtgtaaatactataaaaatgatttattttgaggtctcacatacacacaggcattctttgcctgcccttctt

SEQ ID NO: 159863 - DNA, 510 bp, Homo sapiens
  Payload ID: 11270
  Gene Symbol: NME1
  Gene Name: NME/NM23 nucleoside diphosphate kinase 1
  ENST ID: ENST00000456492
  CDS Start-End: 331-510
ggacatttttagggtgtatttctggcgctttagtcctgttttctcctggacaatttatgcttgccccgcaccccatcgtgcgattctccgcagtctttgggctttgtctctctctctttttttttttttggaagttgcagaatggtgataaatgattttctttgctcctattgactgctaggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgcctt

SEQ ID NO: 159864 - DNA, 1645 bp, Homo sapiens
  Payload ID: 11270
  Gene Symbol: NME1
  Gene Name: NME/NM23 nucleoside diphosphate kinase 1
  ENST ID: ENST00000511355
  CDS Start-End: 87-335
agtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatgttgccagattttctgctgtgattggttttcttctttgaccatatcttcttctgtccttggaggtctgggaggggctgaatgtggtgaagacgggccgagtcatgctcggggagaccaaccctgcagactccaagcctgggaccatccgtggagacttctgcatacaagttggcaggtgagattttggtatttttcccccttttccaaaatctgatttagttgccacaaggatttgggtttccgaggctggaggtagacatgataccatatgcaggttgattttatcggagtttattgttttcctccctcttaagttggcgtttggctttggttgttaacatcacttagtcgtacctctgttacacgaagtgtagaacctggtacaacacactttgctggccagtctttcctgaaggctctcactgtttgcaccagcgtggccgggagggctggatgtggggagggcatttttcagccttaagtgaatggccattgtaggctttttcttttaacatggtctaatgtccatggagcttcagcttttatgctgctgtggctgtagatttctggcaatgggcgcattttaatccttctggtcttggtcatgtgactatctctttctccacccaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttcttttcatgtacactgaataacctgacctaatagagagtgtaaatactataaaaatgatttattttgaggtctcacatacacacaggcattctttgcctgcccttcttaacccccgcatcccttccactcttggcactgagctattcaacaggcatctatggagcatgtgctacgtggccaagactggactaggtgcagaggattcatcagaaatgaaagaaaacatgagggctgggtgtgctggcttgtgcttgtgataccagctacttgggaggctgagatgggagaccagcctgggtaacatagcaagaccctgtctcactaaaaaaaaaaaaagaaa

SEQ ID NO: 159865 - DNA, 964 bp, Homo sapiens
  Payload ID: 11270
  Gene Symbol: NME1
  Gene Name: NME/NM23 nucleoside diphosphate kinase 1
  ENST ID: ENST00000480143
  CDS Start-End: 235-654
gcaagtgctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggtgagattttggtatttttcccccttttccaaaatctgatttagttgccacaaggatttgggtttccgaggctggaggtagacatgataccatatgcaggttgattttatcggagtttattgttttcctccctcttaagttggcgtttggctttggttgttaacatcacttagtcgtacctctgttacacgaagtgtagaacctggtacaacacactttgctggccagtctttcctgaaggctctcactgtttgcaccagcgtggccgggagggctggatgtggggagggcatttttcagccttaagtgaatgg

SEQ ID NO: 159866 - DNA, 781 bp, Homo sapiens
  Payload ID: 11270
  Gene Symbol: NME1
  Gene Name: NME/NM23 nucleoside diphosphate kinase 1
  ENST ID: ENST00000475573
  CDS Start-End: 71-319
tgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatgttgccagattttctgctgtgattggttttcttctttgaccatatcttcttctgtccttggaggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagca

SEQ ID NO: 159867 - DNA, 568 bp, Homo sapiens
  Payload ID: 11271
  Gene Symbol: NME2
  Gene Name: NME/NM23 nucleoside diphosphate kinase 2
  ENST ID: ENST00000393183
  CDS Start-End: 83-331
cggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 159868 - DNA, 866 bp, Homo sapiens
  Payload ID: 11271
  Gene Symbol: NME2
  Gene Name: NME/NM23 nucleoside diphosphate kinase 2
  ENST ID: ENST00000393190
  CDS Start-End: 268-726
gtgggcccggtctgtgggcgccccccgatttcccgcaggtcccgcgcggcgtcggagcgggagattcccttgcagcttgcgccccgcgggccttcgggctccgcagagggacgccggccctgcgcggggcggaagcggccgggaagccacgtgtccccgcggccgcgcgtggtgggggaggagggaccggcggcgcccacgtggcctccgcgggccccgccagagcctgcgcccgggccctgaccgcacctctcgccccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 159869 - DNA, 826 bp, Homo sapiens
  Payload ID: 11271
  Gene Symbol: NME2
  Gene Name: NME/NM23 nucleoside diphosphate kinase 2
  ENST ID: ENST00000512737
  CDS Start-End: 225-683
gcgagggcgcgccccggctgggcgtggacactgttctccggccgcgtcgggccgggcgggtggggcgttcctgcgggttgggcggctgggccctccggggtgtggccaccccgcgctccgccctgcgcccctcctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccggacac

SEQ ID NO: 159870 - DNA, 692 bp, Homo sapiens
  Payload ID: 11271
  Gene Symbol: NME2
  Gene Name: NME/NM23 nucleoside diphosphate kinase 2
  ENST ID: ENST00000513177
  CDS Start-End: 95-553
ctgtaggcgggggagtcatcaaggcagggcagaggcaggaccagatggccgtttgaggtgctgagcaaagctcccggtttgcgcggagaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 159871 - DNA, 749 bp, Homo sapiens
  Payload ID: 11271
  Gene Symbol: NME2
  Gene Name: NME/NM23 nucleoside diphosphate kinase 2
  ENST ID: ENST00000503064
  CDS Start-End: 151-609
gccggctcccgggtgtggtggtcgcaccagctctctgctctcccagcgcagcgccgccgcccggcccctccagcttcccggtaaggcggtgggggcgcatcccctggcgactcctcccgttccctcttccgcttgcgctgccgcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 159872 - DNA, 850 bp, Homo sapiens
  Payload ID: 11271
  Gene Symbol: NME2
  Gene Name: NME/NM23 nucleoside diphosphate kinase 2
  ENST ID: ENST00000514264
  CDS Start-End: 252-710
atctcagggcagtaccactgctgtgcggctgtcagtcagtgctgcaggcgccgagaggaggggcttgtgaccgccccagggaagctgggcatcaccaaagggagcttgtttgccagggacactgcaagtaggaagtgtctacaggtcgatgacaggcctaatctctatgacagggtctagactttcctcagggtccaggggcgcacctcagggtgaactggaaaactcgaccgcactttagtgccaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 159873 - DNA, 1069 bp, Homo sapiens
  Payload ID: 11272
  Gene Symbol: NME3
  Gene Name: NME/NM23 nucleoside diphosphate kinase 3
  Uniprot ID: Q13232
  ENST ID: ENST00000219302
  CDS Start-End: 197-706
agttagtgtccgagctgctggaggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggcctccgaggagctgctgcgtgagcactacgccgagctgcgtgaacgcccgttctacggccgccttgtcaagtatatggcctccgggccggtggtggccatggtatggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgatttgggcccaggaacaggcagctacgacgttaagacatttattacatacagagc

SEQ ID NO: 159874 - DNA, 583 bp, Homo sapiens
  Payload ID: 11272
  Gene Symbol: NME3
  Gene Name: NME/NM23 nucleoside diphosphate kinase 3
  ENST ID: ENST00000563854
  CDS Start-End: 1-174
atcttcgctaacctcttccccgcggcctgcaccggcgcacacgaacgcaccttcctggccgtgaagccggacggcgtgcagcggcggctggtgggcgagattgtgcggcgcttcgagaggaagggcttcaagcggcctgacccttccgcaggcctccgaggagctgctgcgtgagcactacgccgagctgcgtgaacgcccgttctacggccgccttgtcaagtatatggcctccgggccggtggtggccatggtatggcaggggctggacgtggtgcgcacctcgcgggcgctcatcggagccacgaacccggccgacgccccgcccggcaccatccgcggggatttctgcatcgaggaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacg

SEQ ID NO: 159875 - DNA, 813 bp, Homo sapiens
  Payload ID: 11272
  Gene Symbol: NME3
  Gene Name: NME/NM23 nucleoside diphosphate kinase 3
  ENST ID: ENST00000568561
  CDS Start-End: 1-162
ttcgctaacctcttccccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggcggcctgacccttccgcaggcctccgaggagctgctgcgtgagcactacgccgagctgcgtgaacgcccgttctacggccgccttgtcaagtatatggcctccgggccggtggtggccatggtatggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttc

SEQ ID NO: 159876 - DNA, 920 bp, Homo sapiens
  Payload ID: 11272
  Gene Symbol: NME3
  Gene Name: NME/NM23 nucleoside diphosphate kinase 3
  ENST ID: ENST00000563498
  CDS Start-End: 358-615
cgcggatcccgctcccgcaccgccatcatgatctgcctggtgctgaccatcttcgctaacctcttccccgcgggtgagccgcgcggcgcgggccgggggcgggtggccggtgctgggccggcctgacggcccgtccccgcctgccccgcagcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggcctccgaggagctgctgcgtgagcactacgccgagctgcgtgaacgcccgttctacggccgccttgtcaagtatatggcctccgggccggtggtggccatggtatggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtt

SEQ ID NO: 159877 - DNA, 811 bp, Homo sapiens
  Payload ID: 11272
  Gene Symbol: NME3
  Gene Name: NME/NM23 nucleoside diphosphate kinase 3
  ENST ID: ENST00000564628
  CDS Start-End: 1-372
cccgcggcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggtgggggcgcggcctccgaggagctgctgcgtgagcactacgccgagctgcgtgaacgcccgttctacggccgccttgtcaagtatatggcctccgggccggtggtggccatggtatggcaggggctggacgtggtgcgcacctcgcgggcgctcatcggagccacgaacccggccgacgccccgcccggcaccatccgcggggatttctgcatcgaggttggcaagaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgatttgggcccaggaacaggca

SEQ ID NO: 159878 - DNA, 995 bp, Homo sapiens
  Payload ID: 11273
  Gene Symbol: NME4
  Gene Name: NME/NM23 nucleoside diphosphate kinase 4
  Uniprot ID: O00746
  ENST ID: ENST00000219479
  CDS Start-End: 15-578
gcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacacccagttcc

SEQ ID NO: 159879 - DNA, 766 bp, Homo sapiens
  Payload ID: 11273
  Gene Symbol: NME4
  Gene Name: NME/NM23 nucleoside diphosphate kinase 4
  ENST ID: ENST00000382940
  CDS Start-End: 15-602
gcgggccgggcgtcatgggcggcctcttctggcgctccgcgctgcgggggctgcgctgcggcccgcgggccccgggcccgagcctgctagtgcgccacggctcggggctccctccatcggctctgaaaagagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcc

SEQ ID NO: 159880 - DNA, 1232 bp, Homo sapiens
  Payload ID: 11273
  Gene Symbol: NME4
  Gene Name: NME/NM23 nucleoside diphosphate kinase 4
  Uniprot ID: O00746
  ENST ID: ENST00000397722
  CDS Start-End: 475-828
cctccttctcccgccctggggctcacgtgggaatttcaccctccattggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttcccccgagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttg

SEQ ID NO: 159881 - DNA, 985 bp, Homo sapiens
  Payload ID: 11273
  Gene Symbol: NME4
  Gene Name: NME/NM23 nucleoside diphosphate kinase 4
  Uniprot ID: O00746
  ENST ID: ENST00000450036
  CDS Start-End: 558-911
ggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccgcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccaca

SEQ ID NO: 159882 - DNA, 1111 bp, Homo sapiens
  Payload ID: 11273
  Gene Symbol: NME4
  Gene Name: NME/NM23 nucleoside diphosphate kinase 4
  ENST ID: ENST00000444498
  CDS Start-End: 24-725
cagcggcccgcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctgtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacgagatgggttttcaccacgttgaccaggctggtctcgaattcctgacctcaggtgatccgcccacctcagcctcccaaagtgccaggattacaggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgataccagcggcaccttcaatgtgtctcgtgtgctctatgagaagttcttccgg

SEQ ID NO: 159883 - DNA, 966 bp, Homo sapiens
  Payload ID: 11273
  Gene Symbol: NME4
  Gene Name: NME/NM23 nucleoside diphosphate kinase 4
  ENST ID: ENST00000433358
  CDS Start-End: 1-508
ctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcagtcacaggcttgctcccctagacagagggcaacgggagcagcagatggtccctgggattcctcagggtgcacatgaagcctgagcctcacattgctcctgtcctggcacaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagca

SEQ ID NO: 159884 - DNA, 719 bp, Homo sapiens
  Payload ID: 11273
  Gene Symbol: NME4
  Gene Name: NME/NM23 nucleoside diphosphate kinase 4
  ENST ID: ENST00000454619
  CDS Start-End: 609-719
attggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttccccccgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtg

SEQ ID NO: 159885 - DNA, 1167 bp, Homo sapiens
  Payload ID: 11273
  Gene Symbol: NME4
  Gene Name: NME/NM23 nucleoside diphosphate kinase 4
  ENST ID: ENST00000448828
  CDS Start-End: 25-159
acagcggcccgcgggccgggcgtcatgggcggcctcttctggcgctccgcgctgcgggggctgcgctgcggcccgcgggccccgggcccgagcctgctagtgcgccacggctcggcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggtggggaaagagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaa

SEQ ID NO: 159886 - DNA, 904 bp, Homo sapiens
  Payload ID: 11273
  Gene Symbol: NME4
  Gene Name: NME/NM23 nucleoside diphosphate kinase 4
  ENST ID: ENST00000621774
  CDS Start-End: 32-493
cgcgctcacagcggcccgcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccc

SEQ ID NO: 159887 - DNA, 1193 bp, Homo sapiens
  Payload ID: 11273
  Gene Symbol: NME4
  Gene Name: NME/NM23 nucleoside diphosphate kinase 4
  Uniprot ID: O00746
  ENST ID: ENST00000620944
  CDS Start-End: 429-782
cgcgctcacagcggcccgcgggccgggcgtcatgggcggcctcttctggcgctccgcgctgcgggggctgcgctgcggcccgcgggccccgggcccgagcctgctagtgcgccacggctcggcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggtggggaaagagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccc

SEQ ID NO: 159888 - DNA, 1353 bp, Homo sapiens
  Payload ID: 11274
  Gene Symbol: NME6
  Gene Name: NME/NM23 nucleoside diphosphate kinase 6
  Uniprot ID: O75414
  ENST ID: ENST00000452211
  CDS Start-End: 239-799
agaatctggggtgggcttaggccccgggccgcgtgttcttgccacgagaacccctagcagcctggccttggaatggctggatgaggtgcattcgttggttcattcagatactgttaagagccagctgtgtgctaggtactgcttacaccttctggtggtgaagacggaactgaagggaacttgcaaggagctgtgagaaagtgtaacgggaagtgagctaagatcactaaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaaaaaagaa

SEQ ID NO: 159889 - DNA, 638 bp, Homo sapiens
  Payload ID: 11274
  Gene Symbol: NME6
  Gene Name: NME/NM23 nucleoside diphosphate kinase 6
  ENST ID: ENST00000456495
  CDS Start-End: 305-638
ggaggacaaggtgaacccgcagccggacttctgctgcactggggctccgaatgacccagaatctggggtgggcttaggccccgggtacgaggggccgcgtgttcttgccacgagaacccctagcagcctggccttggaatggctggatgaggtgcattcgttggttcattcagatactgttaagagccagctgtgtgctaggtactgcttacaccttctggtggtgaagacggaactgaagggaacttgcaaggagctgtgagaaagtgtaacgggaagtgagctaagatcactaaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccc

SEQ ID NO: 159890 - DNA, 599 bp, Homo sapiens
  Payload ID: 11274
  Gene Symbol: NME6
  Gene Name: NME/NM23 nucleoside diphosphate kinase 6
  Uniprot ID: O75414
  ENST ID: ENST00000435684
  CDS Start-End: 97-588
gtgccggaggacaaggtgaacccgcagccggacttctgctgcactggggctccgaatgacccagaatctggggtgggcttaggccccgggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacagga

SEQ ID NO: 159891 - DNA, 794 bp, Homo sapiens
  Payload ID: 11274
  Gene Symbol: NME6
  Gene Name: NME/NM23 nucleoside diphosphate kinase 6
  ENST ID: ENST00000418431
  CDS Start-End: 43-291
gcgcctggtggccgggccctgtgccggaggacaaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaaggtaaggaggtagaagtacagaaagttgccttgggcaccaggatgaaggtatcttgatgaaggtcctctctctttgcagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcacc

SEQ ID NO: 159892 - DNA, 849 bp, Homo sapiens
  Payload ID: 11274
  Gene Symbol: NME6
  Gene Name: NME/NM23 nucleoside diphosphate kinase 6
  Uniprot ID: O75414
  ENST ID: ENST00000415644
  CDS Start-End: 50-409
cagcgtggcgcctggtggccgggccctgtgccggaggacaaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcag

SEQ ID NO: 159893 - DNA, 913 bp, Homo sapiens
  Payload ID: 11274
  Gene Symbol: NME6
  Gene Name: NME/NM23 nucleoside diphosphate kinase 6
  Uniprot ID: O75414
  ENST ID: ENST00000415053
  CDS Start-End: 163-723
actggggctccgaatgacccagaatctggggtgggcttaggccccgggccgcgtgttcttgccacgagaacccctagcagcctggccttggaatggctggatgaggtgcattcgttggttcattcagatactgttaagagccagctgtgtgctaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatg

SEQ ID NO: 159894 - DNA, 668 bp, Homo sapiens
  Payload ID: 11274
  Gene Symbol: NME6
  Gene Name: NME/NM23 nucleoside diphosphate kinase 6
  ENST ID: ENST00000447724
  CDS Start-End: 484-668
gctccgaatgacccagaatctggggtgggcttaggccccgggtacgaggggattctcgacttgtcagtttgttgtaaaccaagagtcaagacagccacaacttagctgcgttagtaaaggaaccatgtcctccctacaggccgcgtgttcttgccacgagaacccctagcagcctggccttggaatggctggatgaggtgcattcgttggttcattcagatactgttaagagccagctgtgtgctaggtactgcttacaccttctggtggtgaagacggaactgaagggaacttgcaaggagctgtgagaaagtgtaacgggaagtgagctaagatcactaaggtgggcaggaggcaaccagagaaagcacattcaggactgcgaaaactactcacacaaaggctgtcaagccagaaattctttcaaaactgaaaggcccatgaggttggagctagagaaacttaaggagtgtggggttccagatgaggctagagaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaaga

SEQ ID NO: 159895 - DNA, 757 bp, Homo sapiens
  Payload ID: 11274
  Gene Symbol: NME6
  Gene Name: NME/NM23 nucleoside diphosphate kinase 6
  Uniprot ID: O75414
  ENST ID: ENST00000442597
  CDS Start-End: 79-639
gaaggaccctgcgagggccgcaggctatccagcgtggcgcctggtggccgggccctgtgccggaggacaaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccac

SEQ ID NO: 159896 - DNA, 871 bp, Homo sapiens
  Payload ID: 11274
  Gene Symbol: NME6
  Gene Name: NME/NM23 nucleoside diphosphate kinase 6
  Uniprot ID: O75414
  ENST ID: ENST00000451657
  CDS Start-End: 341-832
cgtagcgctgcgccagcacccggcccagcactccctcccgccgagggcgcccaggccggcttccgagggcgcccaggccggcttccgaggggcggttcccacaagcgagttccggcgcccagaacggcttcatcctctcgtcccgtccgcggcaaatgcatgcgcctggaaaacccgccaccctccagggcaactcacacctcacctcacgccgcggcgcaaccggactaggaccccgagcagggctgcccagggagcgcctgaaggaccctgcgagggccgcaggctatccagcgtggcgcctggtggccgggccctgtgccggaggacaaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtcta

SEQ ID NO: 159897 - DNA, 552 bp, Homo sapiens
  Payload ID: 11274
  Gene Symbol: NME6
  Gene Name: NME/NM23 nucleoside diphosphate kinase 6
  ENST ID: ENST00000454531
  CDS Start-End: 151-399
gcgcctggtggccgggccctgtgccggaggacaaggccgcgtgttcttgccacgagaacccctagcagcctggccttggaatggctggatgaggtgcattcgttggttcattcagatactgttaagagccagctgtgtgctaggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaaggtaaggaggtagaagtacagaaagttgccttgggcaccaggatgaaggtatcttgatgaaggtcctctctctttgcagggcgttttttctatcagaggctggtggagttcatggccagcgggccaatccgagcctacatccttgcccacaaggatgccatccagctctggaggacgctcatgggacccaccagagtgttccgagcacgc

SEQ ID NO: 159898 - DNA, 613 bp, Homo sapiens
  Payload ID: 11274
  Gene Symbol: NME6
  Gene Name: NME/NM23 nucleoside diphosphate kinase 6
  ENST ID: ENST00000425930
  CDS Start-End: 92-613
ggtgaacccgcagccggacttctgctgcactggggctccgaatgacccagaatctggggtgggcttaggccccgggtacgaggggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtc

SEQ ID NO: 159899 - DNA, 621 bp, Homo sapiens
  Payload ID: 11274
  Gene Symbol: NME6
  Gene Name: NME/NM23 nucleoside diphosphate kinase 6
  ENST ID: ENST00000447314
  CDS Start-End: 81-506
gcgcctggtggccgggccctgtgccggaggacaaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccac

SEQ ID NO: 159900 - DNA, 2004 bp, Homo sapiens
  Payload ID: 11274
  Gene Symbol: NME6
  Gene Name: NME/NM23 nucleoside diphosphate kinase 6
  ENST ID: ENST00000421967
  CDS Start-End: 47-631
gacaaggtgaacccgcagccggacttctgctgcactggggctccgaatgacccagaatctggggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaaaaaagaagcttgtctaattgacttgcctaaaaaatgcagtgactccaaacaacatttgacctgtcttcctcaataaaagtcagtgttctcctgaatcctttatgctgccacatttaggggaaacttttcaggcttcatcattctgacttctcagcagcattcagttattgcttcattctccagaaacactctcttctcttggattttctgatcccacacccttggttttctccttctgtgtgtttttcttcatctcctttatcagcttatgcaaacatttattttcataaattctctattcaagacatactgaaaaatgcaaagatggttaagacatgattgggtcctcaagttgctaattatgaatttgggtggtcagccagctataacgtggcagagatggagaagtgccctaacagaggtataaagtcctgtgggagaacagaggaaagaaggtttcctttggctgggtgaggaggtgaaggagatagggtggaaagtcttttataaaagatatagctggctttggaactaagcctgaaggtcaaatagggtatccatagcaggggtctggggcactagacagtctgttcattttcaggaatatatgggtcagttttgtatgtgtgacctaagaaacctgtgacacttcttacaggtcttgacttttctttctcagtacatgtgtatttctctttttggtggccttgaaacctttgagttgaaaattgccttcaccatctgccactttcactaatggtagaccaggaaatttggacccactgaacatagagaacaactagaaaagctgtgcaaaatataaaca

SEQ ID NO: 159901 - DNA, 1209 bp, Homo sapiens
  Payload ID: 11274
  Gene Symbol: NME6
  Gene Name: NME/NM23 nucleoside diphosphate kinase 6
  Uniprot ID: O75414
  ENST ID: ENST00000426689
  CDS Start-End: 9-569
ggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaaaaaagaagcttgtctaattgacttgcctaaaaaatgcagtgactccaaacaacatttgacctgtcttcctcaataaaagtcagtgttctcctg

SEQ ID NO: 159902 - DNA, 894 bp, Homo sapiens
  Payload ID: 11275
  Gene Symbol: NME1-NME2
  Gene Name: NME1-NME2 readthrough
  ENST ID: ENST00000376392
  CDS Start-End: 64-657
cgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 159903 - DNA, 1021 bp, Homo sapiens
  Payload ID: 11275
  Gene Symbol: NME1-NME2
  Gene Name: NME1-NME2 readthrough
  Uniprot ID: P22392
  ENST ID: ENST00000393193
  CDS Start-End: 78-881
aaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 159904 - DNA, 1193 bp, Homo sapiens
  Payload ID: 11275
  Gene Symbol: NME1-NME2
  Gene Name: NME1-NME2 readthrough
  ENST ID: ENST00000555572
  CDS Start-End: 177-1055
ggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccg

SEQ ID NO: 159905 - DNA, 1193 bp, Homo sapiens
  Payload ID: 11276
  Gene Symbol: MPG
  Gene Name: N-methylpurine DNA glycosylase
  Uniprot ID: P29372
  ENST ID: ENST00000219431
  CDS Start-End: 232-1128
ctgggctccgcgccggggtccgagtcccacgaagccccggcccgagccgccggatgcccgcgcgcagcggggcccaggtcatgcagcctgggcccccatgccgtgcagctcgcacatatgtggggcagagcagccaccctgcccccagcagcagccgtccatcgtcagacgtgatcatttcctgaggcctcgagtgtgtcagggtgtttgtgcctcataacaacccacaggatggtcacccccgctttgcagatgaagaaaccaaagcagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctag

SEQ ID NO: 159906 - DNA, 1205 bp, Homo sapiens
  Payload ID: 11276
  Gene Symbol: MPG
  Gene Name: N-methylpurine DNA glycosylase
  Uniprot ID: P29372
  ENST ID: ENST00000356432
  CDS Start-End: 248-1129
cgcatcgggcccgggaatcggtccggacctggcggtgggcgctgggaagaggatccacctccacgtggcccgccccgccccgggggcgcagccagttcccggcgctcactgccccccttctcccggcttccgtccccttctgcgcaggcgccgctccgccccggtcctaggggtgcttccgtggtcggcggctgctgggctccgcgccggggtccgagtcccacgaagccccggcccgagccgccggatgcccgcgcgcagcggggcccagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaactgtgcc

SEQ ID NO: 159907 - DNA, 1039 bp, Homo sapiens
  Payload ID: 11276
  Gene Symbol: MPG
  Gene Name: N-methylpurine DNA glycosylase
  Uniprot ID: P29372
  ENST ID: ENST00000397817
  CDS Start-End: 120-965
gtcacactcatctgagggctccagacacatggcctgtgcgtctgtcctgcccagcgtctcccacctgacgcggccaggtgcccagttgctcttcaaggccttttcagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaactgtg

SEQ ID NO: 159908 - DNA, 884 bp, Homo sapiens
  Payload ID: 11276
  Gene Symbol: MPG
  Gene Name: N-methylpurine DNA glycosylase
  ENST ID: ENST00000436333
  CDS Start-End: 132-884
gtaggaccaggtgtcacactcatctgagggctccagacacatggcctgtgcgtctgtcctgcccagcgtctcccacctgacgcggccaggtgcccagttgctcttcaaggccttttcagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggg

SEQ ID NO: 159909 - DNA, 1376 bp, Homo sapiens
  Payload ID: 11277
  Gene Symbol: NMRAL1
  Gene Name: NmrA-like family domain containing 1
  Uniprot ID: Q9HBL8
  ENST ID: ENST00000283429
  CDS Start-End: 377-1276
taagactcatggacatagctttaattatctttgcctgacgcccaatacctgaaaattaagatgttcatgcaagataaagaggtaatttttctcctcctcccagtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagatggcttccagga

SEQ ID NO: 159910 - DNA, 1233 bp, Homo sapiens
  Payload ID: 11277
  Gene Symbol: NMRAL1
  Gene Name: NmrA-like family domain containing 1
  Uniprot ID: Q9HBL8
  ENST ID: ENST00000404295
  CDS Start-End: 248-1147
cacgtcgggattggcggctgcagccaggggtcctccgacgctgggcttccgtgagcggcgctctgccaggtggggccggagctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctccca

SEQ ID NO: 159911 - DNA, 731 bp, Homo sapiens
  Payload ID: 11277
  Gene Symbol: NMRAL1
  Gene Name: NmrA-like family domain containing 1
  ENST ID: ENST00000573571
  CDS Start-End: 168-731
gctgcggggagggagttggcgcctagcgcgcagctccatccccgcctctgcagtggactcggccgcagaatcggggtcccgggctcctggaacttgtcccgcccaggccgcggcgaggaggtcactccagccgatctctggaccggattcgtcccattctcgtcctcatggtggacaagaaactggtggtggttttcggaggcacagagatatggtttcaccatgttgcccaggctggtctcaaactcctgagctcaagagatctgcgtgcctcagcctcccaaagtgtctggattacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgag

SEQ ID NO: 159912 - DNA, 1719 bp, Homo sapiens
  Payload ID: 11277
  Gene Symbol: NMRAL1
  Gene Name: NmrA-like family domain containing 1
  Uniprot ID: Q9HBL8
  ENST ID: ENST00000574733
  CDS Start-End: 731-1630
gggcgggaagcggagtatgtggctttccccaggtctctggaggttgcaggctcaggctctgctcagcgggtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccaggtggggccggagctgcggggagggagttggcgcctagcgcgcagctccatccccgcctctgcagtggactcggccgcagaatcggggtcccgggctcctggaacttgtcccgcccaggccgcggcgaggaggtcactccagccggtgggacccgggccggggggcgggtgactggaaccgggggaggcgggaaggaggaggggatcgggcccaagggacacgaggtgggtcgcgggaccccgatatctcgggacaggcgtcttgccgctccgggcccagccgcccccttcgacacatactcgatgcatagacaatgggggtgtcctttgtcgctcctggcgggaaccccggccccacccccaactccacgcctcccattacccccagatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccagat

SEQ ID NO: 159913 - DNA, 787 bp, Homo sapiens
  Payload ID: 11277
  Gene Symbol: NMRAL1
  Gene Name: NmrA-like family domain containing 1
  ENST ID: ENST00000573520
  CDS Start-End: 133-306
aactgcgccggaggaggggtttcggccgacacgtcgggattggcggctgcagccaggggtcctccgacgctgggcttccgtgagcggcgctctgccagatctctggaccggattcgtcccattctcgtcctcatggtggacaagaaactggtggtggttttcggaggcacagagatatggtttcaccatgttgcccaggctggtctcaaactcctgagctcaagagatctgcgtgcctcagcctcccaaagtgtctggattacaggcatgagcccctgggcccagctgcaacgcgcaaaatcttaagggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagc

SEQ ID NO: 159914 - DNA, 659 bp, Homo sapiens
  Payload ID: 11277
  Gene Symbol: NMRAL1
  Gene Name: NmrA-like family domain containing 1
  ENST ID: ENST00000572232
  CDS Start-End: 1-573
aacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaaggtgggcctcccgccccagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctccca

SEQ ID NO: 159915 - DNA, 927 bp, Homo sapiens
  Payload ID: 11277
  Gene Symbol: NMRAL1
  Gene Name: NmrA-like family domain containing 1
  ENST ID: ENST00000571291
  CDS Start-End: 335-460
gcggagtatgtggctttccccaggtctctggaggttgcaggctcaggctctgctcagcgggtcatcacccgtagcatccggttaagaggctctccacctcgctcattttggtctaactggatttacacaaactcactgtgcacgtgcctggggcgggcaaacccggaaacgacgccgagtcccgcgggatccaggaggagccaactgcgccggaggaggggtttcggccgacacgtcgggattggcggctgcagccaggggtcctccgacgctgggcttccgtgagcggcgctctgccagatctctggaccggattcgtcccattctcgtcctcatggtggacaagaaactggtggtggttttcggaggcacagaggcggggtttcaccaagccaagatcgtgccactgcacttcagcctgggtgatagagtgagactccatctcaaaaaaataaaataaagaaaataaaaatacctgaatgagaatcgtcgttgagaaggtttcctggatgctccttgctgtggtggagcactcccttcggggtttcgcccttcagtgggactttcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcg

SEQ ID NO: 159916 - DNA, 1240 bp, Homo sapiens
  Payload ID: 11277
  Gene Symbol: NMRAL1
  Gene Name: NmrA-like family domain containing 1
  Uniprot ID: Q9HBL8
  ENST ID: ENST00000574425
  CDS Start-End: 256-1155
cggaggaggggtttcggccgacacgtcgggattggcggctgcagccaggggtcctccgacgctgggcttccgtgagcggcgctctgccaggtggggccggagctgcggggagggagttggcgcctagcgcgcagctccatccccgcctctgcagtggactcggccgcagaatcggggtcccgggctcctggaacttgtcccgcccaggccgcggcgaggagatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctccc

SEQ ID NO: 159917 - DNA, 672 bp, Homo sapiens
  Payload ID: 11277
  Gene Symbol: NMRAL1
  Gene Name: NmrA-like family domain containing 1
  ENST ID: ENST00000576176
  CDS Start-End: 1-672
gaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaaggtgggcctcccgccccaggtgactcaggcatccttgtcagggctttctagctcccgtagggagggtgtgtccagggctgcccacacctctgg

SEQ ID NO: 159918 - DNA, 456 bp, Homo sapiens
  Payload ID: 11277
  Gene Symbol: NMRAL1
  Gene Name: NmrA-like family domain containing 1
  ENST ID: ENST00000572110
  CDS Start-End: 1-375
gacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttc

SEQ ID NO: 159919 - DNA, 805 bp, Homo sapiens
  Payload ID: 11277
  Gene Symbol: NMRAL1
  Gene Name: NmrA-like family domain containing 1
  ENST ID: ENST00000571448
  CDS Start-End: 1-480
caggggaagctgctcgctgatctggccaggcgcctgggcctccactatgtggtctacagcggcctggagaacatcaagaagctgacggcagggagattggccgccgcgcactttgacggcaaaggggaggtggaggaatatttccgggacattggcgttcccatgaccagtgtgcggctgccctgctattttgagaacctcctctcccacttcttgccccagaaagccccagacggaaagagctacttgctgagcttgcccacaggtgacgttcccatggatggcatgtccgtgtctgacctgggtcctgtggtgctcagccttttgaagatgccagaaaaatacgtcggccagaacatcgggctgagcacttgcaggcacacggccgaggagtacgctgccctgctcaccaagcacacccgcaaggtcgtgcacgatgccaaggagctaactggccacagagtgaaatttctggcttagatgttttgaccaaatagagagaaaagcttccaggaggagagggccataggagccaagatgactcctgaggactacgaaaagcttggctttcccggtgcccgggacctggccaacatgttccgtttctatgccctgagacccgaccgtgacatcgagctgaccctgagactcaaccccaaggccctgacgctggaccagtggctggaacagcacaaaggggacttcaacctgctgtgacctgcccgcctcgcggccccttgtggggatcgggggcaccagaggggcagaggcaccaacatctgaataaagccattgttctcccaga

SEQ ID NO: 159920 - DNA, 1376 bp, Homo sapiens; identical to SEQ ID NO: 159909
  Payload ID: 11277
  Gene Symbol: NMRAL1
  Gene Name: NmrA-like family domain containing 1
  Uniprot ID: Q9HBL8
  ENST ID: ENST00000621810
  CDS Start-End: 377-1276

SEQ ID NO: 159921 - DNA, 1233 bp, Homo sapiens; identical to SEQ ID NO: 159910
  Payload ID: 11277
  Gene Symbol: NMRAL1
  Gene Name: NmrA-like family domain containing 1
  Uniprot ID: Q9HBL8
  ENST ID: ENST00000616587
  CDS Start-End: 248-1147

SEQ ID NO: 159922 - DNA, 456 bp, Homo sapiens; identical to SEQ ID NO: 159918
  Payload ID: 11277
  Gene Symbol: NMRAL1
  Gene Name: NmrA-like family domain containing 1
  ENST ID: ENST00000631933
  CDS Start-End: 1-375

SEQ ID NO: 159923 - DNA, 787 bp, Homo sapiens; identical to SEQ ID NO: 159913
  Payload ID: 11277
  Gene Symbol: NMRAL1
  Gene Name: NmrA-like family domain containing 1
  ENST ID: ENST00000633905
  CDS Start-End: 133-306

SEQ ID NO: 159924 - DNA, 672 bp, Homo sapiens; identical to SEQ ID NO: 159917
  Payload ID: 11277
  Gene Symbol: NMRAL1
  Gene Name: NmrA-like family domain containing 1
  ENST ID: ENST00000631694
  CDS Start-End: 1-672

SEQ ID NO: 159925 - DNA, 805 bp, Homo sapiens; identical to SEQ ID NO: 159919
  Payload ID: 11277
  Gene Symbol: NMRAL1
  Gene Name: NmrA-like family domain containing 1
  ENST ID: ENST00000631867
  CDS Start-End: 1-480

SEQ ID NO: 159926 - DNA, 731 bp, Homo sapiens; identical to SEQ ID NO: 159911
  Payload ID: 11277
  Gene Symbol: NMRAL1
  Gene Name: NmrA-like family domain containing 1
  ENST ID: ENST00000633784
  CDS Start-End: 168-731

SEQ ID NO: 159927 - DNA, 1240 bp, Homo sapiens; identical to SEQ ID NO: 159916
  Payload ID: 11277
  Gene Symbol: NMRAL1
  Gene Name: NmrA-like family domain containing 1
  Uniprot ID: Q9HBL8
  ENST ID: ENST00000633085
  CDS Start-End: 256-1155

SEQ ID NO: 159928 - DNA, 927 bp, Homo sapiens; identical to SEQ ID NO: 159915
  Payload ID: 11277
  Gene Symbol: NMRAL1
  Gene Name: NmrA-like family domain containing 1
  ENST ID: ENST00000632279
  CDS Start-End: 335-460

SEQ ID NO: 159929 - DNA, 1719 bp, Homo sapiens; identical to SEQ ID NO: 159912
  Payload ID: 11277
  Gene Symbol: NMRAL1
  Gene Name: NmrA-like family domain containing 1
  Uniprot ID: Q9HBL8
  ENST ID: ENST00000632013
  CDS Start-End: 731-1630

SEQ ID NO: 159930 - DNA, 659 bp, Homo sapiens; identical to SEQ ID NO: 159914
  Payload ID: 11277
  Gene Symbol: NMRAL1
  Gene Name: NmrA-like family domain containing 1
  ENST ID: ENST00000632312
  CDS Start-End: 1-573

SEQ ID NO: 159931 - DNA, 1623 bp, Homo sapiens
  Payload ID: 11278
  Gene Symbol: NMI
  Gene Name: N-myc (and STAT) interactor
  Uniprot ID: Q13287
  ENST ID: ENST00000243346
  CDS Start-End: 472-1395
taccttataaaatacatgcaaaaaactggttttagaaagcgttccctaaaattagtgtgtacggaaacttcaggtatacttctgctttcctccgcaaaaccacccctttttaaaaatcgaaagtgaaattagtttttttttctgttagtgactaatcattggagacaaccatgtttagtatttgagcattggttaaatgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctcccggggttccggcgtttcaggcgctgctgttttccgggaagggcaggcgcgctgggccttggggagctgcgctcggcgggcggacgcgggggatcatggaagctgataaagatgacacacaacaaattcttaaggagcattcgccagatgaatttataaaagatgaacaaaataagggactaattgatgaaattacaaagaaaaatattcaactaaagaaggagatccaaaagcttgaaacggagttacaagaggctaccaaagaattccagattaaagaggatattcctgaaacaaagatgaaattcttatcagttgaaactcctgagaatgacagccagttgtcaaatatctcctgttcgtttcaagtgagctcgaaagttccttatgagatacaaaaaggacaagcacttatcacctttgaaaaagaagaagttgctcaaaatgtggtaagcatgagtaaacatcatgtacagataaaagatgtaaatctggaggttacggccaagccagttccattaaattcaggagtcagattccaggtttatgtagaagtttctaaaatgaaaatcaatgttactgaaattcctgacacattgcgtgaagatcaaatgagagacaaactagagctgagcttttcaaagtcccgaaatggaggcggagaggtggaccgcgtggactatgacagacagtccgggagtgcagtcatcacgtttgtggagattggagtggctgacaagattttgaaaaagaaagaataccctctttatataaatcaaacctgccatagagttactgtttctccatacacagaaatacacttgaaaaagtatcagatattttcaggaacatctaagaggacagtgcttctgacaggaatggaaggcattcaaatggatgaagaaattgtggaggatttaattaacattcactttcaacgggcaaagaatggaggtggagaagtagatgtggtcaagtgttctctaggtcaacctcacatagcatactttgaagaatagacttaacagaatcatgaaaactatagctttttaacccggattactgtaaatgtttgacaaaaatgaatatgcttttccttaaaaaatgaaaactttaatttttaccatccatttatgtttagatacaaaacttatttccatgtttctgaatcttctttgtttcaaatggtgctgcatgttttcaactacaataagtgcactgtaataaaaagttttgtttatagatta

SEQ ID NO: 159932 - DNA, 581 bp, Homo sapiens
  Payload ID: 11278
  Gene Symbol: NMI
  Gene Name: N-myc (and STAT) interactor
  ENST ID: ENST00000414946
  CDS Start-End: 496-581
gacaaccatgtttagtatttgagcattggttaaatgctaaagaaaaatcgccgttaaagcagttttctttttcactgtctttttcttttcgcggggaacccagctgttcctgcgagggccacctcctcaggaagaccccgcagctctcccgcggcgcttctgcaggaggcagcgacagtttcgagaacccgggccttcccctcccagtgcctcccggggttccggcgtttcaggcgctgctgttttccgggaagggcaggcgcgctgggccttggggagctgcgctcggcgggcggacgcggtagagacggggtttcaccgtgttaaccaggatggatacgatctcctgacctcgtgatccgcacgcctcggcctcccaaagtgctgggattacaggcgtgagccaccgcgcccggccctcgctgttttctccgagtgtctctggagatagtccttaggaaaacggatttcttaagaaaacgattcttggggatcatggaagctgataaagatgacacacaacaaattcttaaggagcattcgccagatgaatttataaaagatgaacaaaataagggact

SEQ ID NO: 159933 - DNA, 3014 bp, Homo sapiens
  Payload ID: 11279
  Gene Symbol: NDRG1
  Gene Name: N-myc downstream regulated 1
  Uniprot ID: Q92597
  ENST ID: ENST00000323851
  CDS Start-End: 123-1307
cccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcgg

SEQ ID NO: 159934 - DNA, 3755 bp, Homo sapiens
  Payload ID: 11279
  Gene Symbol: NDRG1
  Gene Name: N-myc downstream regulated 1
  Uniprot ID: Q92597
  ENST ID: ENST00000414097
  CDS Start-End: 869-2053
acacaaacgcctcctccgggcagggcacacgcgcccgctgcacaggccgaggccctggactcggaggggactgcagagccgacccacaacccgggccccgatgcccctcccggccgcgcccctacgactgcttgcgcaacaggcggcggctccagtgggcgcccgccgcgcgctgccggagcccagcccagcccggcgcgcccgggaggagggagcagggagcggggaaggggtgtgtcccggctgcgtgctgggactgcgagggtctgggaggggcgaggcgcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 159935 - DNA, 1385 bp, Homo sapiens
  Payload ID: 11279
  Gene Symbol: NDRG1
  Gene Name: N-myc downstream regulated 1
  Uniprot ID: Q92597
  ENST ID: ENST00000522476
  CDS Start-End: 219-1205
aaacctcgcctggctcccagctggtgctgaagctcgtcagttcaccatccgccctcggcttccgcggggcgctgggccgccagcctcggcaccgtcctttcctttctccctcgcgttaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaa

SEQ ID NO: 159936 - DNA, 582 bp, Homo sapiens
  Payload ID: 11279
  Gene Symbol: NDRG1
  Gene Name: N-myc downstream regulated 1
  ENST ID: ENST00000520230
  CDS Start-End: 3-582
agatggcagtccctccacctgggatcatgaagcaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccg

SEQ ID NO: 159937 - DNA, 581 bp, Homo sapiens
  Payload ID: 11279
  Gene Symbol: NDRG1
  Gene Name: N-myc downstream regulated 1
  ENST ID: ENST00000522890
  CDS Start-End: 108-581
aaaggggccgcccgtgcggtgccgctggagcgccaggaccgccctttgtagccccgcgtactccaggagtaagcgccccggagctgcaagcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 159938 - DNA, 558 bp, Homo sapiens
  Payload ID: 11279
  Gene Symbol: NDRG1
  Gene Name: N-myc downstream regulated 1
  ENST ID: ENST00000518480
  CDS Start-End: 259-558
aaacaaacctcgcctggctcccagctggtgctgaagctcgtcagttcaccatccgccctcggcttccgcggggcgctgggccgccagcctcggcaccgtcctttcctttctccctcgcgttagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaac

SEQ ID NO: 159939 - DNA, 530 bp, Homo sapiens
  Payload ID: 11279
  Gene Symbol: NDRG1
  Gene Name: N-myc downstream regulated 1
  ENST ID: ENST00000522738
  CDS Start-End: 30-530
agtcccgtagcacacacagggcggtgtgcatgtcaggcagccgagagtcctgcaccgtggggtgtgtatgtgtgttcacgcgcatgcgtgtgcctgtgtgtctgtgcgtctgcatcaccaaccttctgttagggctaactgtgaggctgaagcttgcactatgcctatacgtggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccc

SEQ ID NO: 159940 - DNA, 888 bp, Homo sapiens
  Payload ID: 11279
  Gene Symbol: NDRG1
  Gene Name: N-myc downstream regulated 1
  ENST ID: ENST00000518176
  CDS Start-End: 123-548
cccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagccta

SEQ ID NO: 159941 - DNA, 2918 bp, Homo sapiens
  Payload ID: 11279
  Gene Symbol: NDRG1
  Gene Name: N-myc downstream regulated 1
  ENST ID: ENST00000517599
  CDS Start-End: 138-425
aaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccagacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgc

SEQ ID NO: 159942 - DNA, 550 bp, Homo sapiens
  Payload ID: 11279
  Gene Symbol: NDRG1
  Gene Name: N-myc downstream regulated 1
  ENST ID: ENST00000519580
  CDS Start-End: 77-550
gagaggctggtggcgcttcagtcccgtagcacacacagggcggtgtgcatgtgtgagtgcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggag

SEQ ID NO: 159943 - DNA, 1103 bp, Homo sapiens
  Payload ID: 11279
  Gene Symbol: NDRG1
  Gene Name: N-myc downstream regulated 1
  ENST ID: ENST00000522377
  CDS Start-End: 125-775
ctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagcctttcgattaccaggcattggtattagatactgtgatgtgtgcagttacttcttgcagtccttcccttgaccttgtggccttgaagttcctggcactcccagttccagattagaagtctgagacccagagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactct

SEQ ID NO: 159944 - DNA, 709 bp, Homo sapiens
  Payload ID: 11279
  Gene Symbol: NDRG1
  Gene Name: N-myc downstream regulated 1
  ENST ID: ENST00000521544
  CDS Start-End: 310-709
aaacctcgcctggctcccagctggtgctgaagctcgtcagttcaccatccgccctcggcttccgcggggcgctgggccgccagcctcggcaccgtcctttcctttctccctcgcgttagaaggagatcacagacaccagaagacagcagcttctgccagaactgggtccttccatgattctcaggtggtgactttgaatcccagaaaaagtgttttggggagagtggagtgaaggaagagtgtgaacattggatctgactccactccagcccctgtgctgcagccagcagggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagca

SEQ ID NO: 159945 - DNA, 536 bp, Homo sapiens
  Payload ID: 11279
  Gene Symbol: NDRG1
  Gene Name: N-myc downstream regulated 1
  ENST ID: ENST00000520943
  CDS Start-End: 67-536
agcttgccctgggtctggtcctgggctcagtggcaaattcaacgctgggcaggtggcctgaggacaatgacggtgccagctgcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcct

SEQ ID NO: 159946 - DNA, 729 bp, Homo sapiens
  Payload ID: 11279
  Gene Symbol: NDRG1
  Gene Name: N-myc downstream regulated 1
  ENST ID: ENST00000519228
  CDS Start-End: 235-729
agtgggcaaggtccagtgagtgtgcttagaactgggaagatgaggggaagggtaagcgctgggcggcggtgggcaagatggacgagattaaacgggagcgaggatttcagcgagagctttggcgacacggaaggctgagaatcggagggagcctgtcgggcgaaagcgaaggcggctgctgggcaggcagccgaatccggctggagagccgagctggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtg

SEQ ID NO: 159947 - DNA, 562 bp, Homo sapiens
  Payload ID: 11279
  Gene Symbol: NDRG1
  Gene Name: N-myc downstream regulated 1
  ENST ID: ENST00000523892
  CDS Start-End: 435-562
aaacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagattgagggaaatgcttagaggtctccactgcctcttctactcacaagagactgaaatttaatccaggtccagatgacagcagccatggaaaaaataccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagg

SEQ ID NO: 159948 - DNA, 560 bp, Homo sapiens
  Payload ID: 11279
  Gene Symbol: NDRG1
  Gene Name: N-myc downstream regulated 1
  ENST ID: ENST00000518066
  CDS Start-End: 138-449
aaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatcca

SEQ ID NO: 159949 - DNA, 2975 bp, Homo sapiens
  Payload ID: 11279
  Gene Symbol: NDRG1
  Gene Name: N-myc downstream regulated 1
  Uniprot ID: Q92597
  ENST ID: ENST00000537882
  CDS Start-End: 327-1268
gcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccagacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggtggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcgg

SEQ ID NO: 159950 - DNA, 4879 bp, Homo sapiens
  Payload ID: 11280
  Gene Symbol: NMT1
  Gene Name: N-myristoyltransferase 1
  Uniprot ID: P30419
  ENST ID: ENST00000258960
  CDS Start-End: 19-1509
ctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatccagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccgtcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctg

SEQ ID NO: 159951 - DNA, 1066 bp, Homo sapiens
  Payload ID: 11280
  Gene Symbol: NMT1
  Gene Name: N-myristoyltransferase 1
  ENST ID: ENST00000543908
  CDS Start-End: 11-424
gcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctggctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtaaaactgtcttcctgtaaggccccaaaaatgcgggtgtctgcactgtagttgaggagcatgtgccactgtgagtcacagctccgcccttagcatcccacctctggcgtatctggtaaggcgggcacttggtgcctgcaggagccagatggggagcatggagagggcgggagggttgtagggatggcagattggcaagtccctgccttgtctggagggctcttggtgtctgctggctgctgccatttggagatggtggggggcggtactggtggtttgtttttgttttta

SEQ ID NO: 159952 - DNA, 807 bp, Homo sapiens
  Payload ID: 11280
  Gene Symbol: NMT1
  Gene Name: N-myristoyltransferase 1
  ENST ID: ENST00000585561
  CDS Start-End: 1-266
cggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaaggttggagtgcagaagtacgaacatggctgaccgcagcctcaacctcctgggctcaagcaatcttcccacctcagcctcccgagtagccaggactacagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacac

SEQ ID NO: 159953 - DNA, 558 bp, Homo sapiens
  Payload ID: 11280
  Gene Symbol: NMT1
  Gene Name: N-myristoyltransferase 1
  ENST ID: ENST00000592654
  CDS Start-End: 342-558
taaaagttctatgcagtgttccactcgtgtgcttcaggccattcctgggaaaagagcatgttggacgatggttttcgatggtacaacacaggacagtctagtaacagtacagttcaaagggaacgttacttatagacgtgttgtttgaacaacgtgactagcaataaacgaatcataaaacatttcgcagcagttcaccctcagtgaggaaactcatcagactatacaaacttggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgc

SEQ ID NO: 159954 - DNA, 4999 bp, Homo sapiens
  Payload ID: 11280
  Gene Symbol: NMT1
  Gene Name: N-myristoyltransferase 1
  Uniprot ID: P30419
  ENST ID: ENST00000592782
  CDS Start-End: 132-1622
caggccggctcagcgggcgaggcgggacctcgggagcgcgcgcctgcagaccggacgtccggccagcaggcggggccgggagaggaaccccccatgtagtggggcgcggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatccagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccgtcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaa

SEQ ID NO: 159955 - DNA, 2457 bp, Homo sapiens
  Payload ID: 11281
  Gene Symbol: NMT2
  Gene Name: N-myristoyltransferase 2
  ENST ID: ENST00000378150
  CDS Start-End: 99-1556
agccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaacacaacaccatctggcagcagatttcagcgggagcagccatggaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggag

SEQ ID NO: 159956 - DNA, 2907 bp, Homo sapiens
  Payload ID: 11281
  Gene Symbol: NMT2
  Gene Name: N-myristoyltransferase 2
  Uniprot ID: O60551
  ENST ID: ENST00000378165
  CDS Start-End: 82-1578
agtacggcgggaggcactagagggagctgcggccgctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagcctgggtgacagagcgtgagactccgtctcaaaaaaaaaaaaaaagaaagagcctgtacccgcgactaactagacttttctgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttgttactgatggtgtttttaatctagaatttgaaaaactt

SEQ ID NO: 159957 - DNA, 2076 bp, Homo sapiens
  Payload ID: 11282
  Gene Symbol: NOBOX
  Gene Name: NOBOX oogenesis homeobox
  Uniprot ID: O60393
  ENST ID: ENST00000467773
  CDS Start-End: 1-2076
atggctctccttttgacactaacatcaccagacctggagggtacctgggacaccagagacaaggatggcttcaaagcccaggaggggccgcccctggctgtacctgaatttcctgtgtgtggactgtaccggatctacggagtctgtggctctttcagctccttcttcatcatccggtgcagcctttgtgctctggagaccctcaaatcaccccaacatgatcccttagagatacctgaacagtccctcaaactcatacccctggtgtctgggaaaagggaactcacaaggggccagaaagctggagagaagcccctggctgcaggacccggggaggaggaactgctccggggctcagcccctcatgctcaggacactcagagtgaggaactgccaccctcctgcaccatctcaggagagaagaagccgccagcagtctctggagaagccaccggggctgatgctgggagactgtgcccgcccccccgctccagggctccccacaaagacagaactctagcccgctccaggccccagactcagggggaagattgttccctcccagtgggagaggtgaagataggaaagaggtcctattctccagcccccgggaagcagaaaaagcctaatgccatgggtctggccccaacatcatctccgggtgcccctaactcagcccgtgccacacacaacccagtgccctgtgggtcaggccgggggccctgccacctggccaatctcctcagtacattggcgcagagcaaccaaaacagagaccacaagcaggggcccccggaagtgacctgccaaattaggaaaaagacacgaaccctataccgctcagatcagctggaggagctagagaagatattccaagaagaccactatcctgacagtgataaacgccgagagattgcccagacggtgggggtgaccccccagcgcatcatggtaaagggggccggctcactggtggcagggtggagtggcggagggcccaccattgaaacactcgaattgcagagtgagcgctcagcggtagcctgggtgtggttccagaatcgccgggccaagtggcgaaaaatggagaaactgaatgggaaagaaagcaaggacaatcctgcagcccctggccctgccagcagtcaatgcagctctgcagctgagatcctacctgctgtgcccatggagccaaagcctgaccctttccctcaggagtcccctctggatacctttccagagccccccatgctgctgacttctgaccagactttggcccccacccaacccagtgagggtgctcagagggtggtgacccccccactcttcagccccccacctgtgcgaagggccgatcttcctttcccccttggccctgtccacaccccccaactgatgccactgctgatggatgttgctggcagtgacagcagccacaaggacggcccctgtgggtcctgggggacaagcatcaccctgccacccccctgttcatatttggaggagctggagccccaggattaccaacagagcaaccagccaggacccttccagttctcccaggctccacagcccccgcttttccagtcccctcagcccaagttgccctacctccccactttccccttctccatgcccagttcactgacgcttccaccgcccgaagactctctctttatgtttccctgtggccccagcgggggcacatcgcagggctattgcccaggtgcctcctcaggacagatcctgatgcaaccacctgctgggaatataggtacagcctcctggagtgacccctgtttgccagagctgcccttccctggtccgttctgcccacaagctctggggcatcccccaggaggggatggctactttcctgatctatttccaactccctgcccccaggctctgggcaggcagccttcgtcagctctctcatggatgcctgaaggggccagaccagggactgggcccttactcagcaaggcaaaagaggaaccaccagctgcttccctggatcagccctcagcactggaggaggccagaggggatgacaagaatagccatgtcccctag

SEQ ID NO: 159958 - DNA, 1980 bp, Homo sapiens
  Payload ID: 11282
  Gene Symbol: NOBOX
  Gene Name: NOBOX oogenesis homeobox
  Uniprot ID: O60393
  ENST ID: ENST00000483238
  CDS Start-End: 1-1980
atggctctccttttgacactaacatcaccagacctggagggtacctgggacaccagagacaaggatggcttcaaagcccaggaggggccgcccctggctgtacctgaatttcctgtgtgtggactgtaccggatctacggagtctgtggctctttcagctccttcttcatcatccggtgcagcctttgtgctctggagaccctcaaatcaccccaacatgatcccttagagatacctgaacagtccctcaaactcatacccctggtgtctgggaaaagggaactcacaaggggccagaaagctggagagaagcccctggctgcaggacccggggaggaggaactgctccggggctcagcccctcatgctcaggacactcagagtgaggaactgccaccctcctgcaccatctcaggagagaagaagccgccagcagtctctggagaagccaccggggctgatgctgggagactgtgcccgcccccccgctccagggctccccacaaagacagaactctagcccgctccaggccccagactcagggggaagattgttccctcccagtgggagaggtgaagataggaaagaggtcctattctccagcccccgggaagcagaaaaagcctaatgccatgggtctggccccaacatcatctccgggtgcccctaactcagcccgtgccacacacaacccagtgccctgtgggtcaggccgggggccctgccacctggccaatctcctcagtacattggcgcagagcaaccaaaacagagaccacaagcaggggcccccggaagtgacctgccaaattaggaaaaagacacgaaccctataccgctcagatcagctggaggagctagagaagatattccaagaagaccactatcctgacagtgataaacgccgagagattgcccagacggtgggggtgaccccccagcgcatcatggtgtggttccagaatcgccgggccaagtggcgaaaaatggagaaactgaatgggaaagaaagcaaggacaatcctgcagcccctggccctgccagcagtcaatgcagctctgcagctgagatcctacctgctgtgcccatggagccaaagcctgaccctttccctcaggagtcccctctggatacctttccagagccccccatgctgctgacttctgaccagactttggcccccacccaacccagtgagggtgctcagagggtggtgacccccccactcttcagccccccacctgtgcgaagggccgatcttcctttcccccttggccctgtccacaccccccaactgatgccactgctgatggatgttgctggcagtgacagcagccacaaggacggcccctgtgggtcctgggggacaagcatcaccctgccacccccctgttcatatttggaggagctggagccccaggattaccaacagagcaaccagccaggacccttccagttctcccaggctccacagcccccgcttttccagtcccctcagcccaagttgccctacctccccactttccccttctccatgcccagttcactgacgcttccaccgcccgaagactctctctttatgtttccctgtggccccagcgggggcacatcgcagggctattgcccaggtgcctcctcaggacagatcctgatgcaaccacctgctgggaatataggtacagcctcctggagtgacccctgtttgccagagctgcccttccctggtccgttctgcccacaagctctggggcatcccccaggaggggatggctactttcctgatctatttccaactccctgcccccaggctctgggcaggcagccttcgtcagctctctcatggatgcctgaaggggccagaccagggactgggcccttactcagcaaggcaaaagaggaaccaccagctgcttccctggatcagccctcagcactggaggaggccagaggggatgacaagaatagccatgtcccctag

SEQ ID NO: 159959 - DNA, 2790 bp, Homo sapiens
  Payload ID: 11283
  Gene Symbol: NOC2L
  Gene Name: NOC2-like nucleolar associated transcriptional repressor
  Uniprot ID: Q9Y3T9
  ENST ID: ENST00000327044
  CDS Start-End: 51-2300
cgcgcggcattctggggccggaagtggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtgcctctgagcacaaagaccagctctctcggctgaaggacagagaccccgagttctacaagttcctgcaggagaatgaccagagcctgctaaacttcagcgactcggacagctctgaggaggaagaggggccgttccactccctgccagatgtgctggaggaagccagtgaggaggaggatggagcggaggaaggagaagatggggacagagtccccagagggctgaaggggaagaagaattctgttcctgtgaccgtcgccatggttgagagatggaagcaggcagcaaagcaacgcctcactccaaagctgttccatgaagtggtacaggcgttccgagcagctgtggccaccacccgaggggaccaggaaagtgctgaggccaacaaattccaggtcacggacagtgctgcattcaatgctctggttaccttctgcatcagagacctcattggctgtctccagaagctgctgtttggaaaggtggcaaaggatagcagcaggatgctgcagccgtccagcagcccgctctgggggaagcttcgtgtggacatcaaggcttacctgggctcggccatacagctggtgtcctgtctgtcggagacgacggtgttggcggccgtgctgcggcacatcagcgtgctggtgccctgcttcctgaccttccccaagcagtgccgcatgctgctcaagagaatggtgatcgtatggagcactggggaagagtctctgcgggtgctggctttcctggtcctcagcagagtctgccggcacaagaaggacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccactcgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgcctttcatcctggagatgttccagcaggtcgacttcaacaggaagccagggcgcatgagctccaagcccatcaacttctccgtgatcctgaagctgtccaatgtcaacctgcaggagaaggcgtaccgggacggcctggtggagcagctgtacgacctcaccctggagtacctgcacagccaggcacactgcatcggcttcccggagctggtgctgcctgtggtcctgcagctgaagtcgttcctccgggagtgcaaggtggccaactactgccggcaggtgcagcagctgcttgggaaggttcaggagaactcggcatacatctgcagccgccgccagagggtttccttcggcgtctctgagcagcaggcagtggaagcctgggagaagctgacccgggaagaggggacacccctgaccttgtactacagccactggcgcaagctgcgtgaccgggagatccagctggagatcagtggcaaagagcggctggaagacctgaacttccctgagatcaaacgaaggaagatggctgacaggaaggatgaggacaggaagcaatttaaagacctctttgacctgaacagctctgaagaggacgacaccgagggattctcggagagagggatactgaggcccctgagcactcggcatggggtggaagacgatgaagaggacgaggaggagggcgaggaggacagcagcaactcggaggatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttgaaaatttgttcctttcctttgaagtcacattttcttttaaaattttttgttttgcatccgaaaccgaaagaaataaagcggtgggaggcagggccattgtgttg

SEQ ID NO: 159960 - DNA, 3455 bp, Homo sapiens
  Payload ID: 11284
  Gene Symbol: NOC3L
  Gene Name: NOC3-like DNA replication regulator
  Uniprot ID: Q8WTT2
  ENST ID: ENST00000371361
  CDS Start-End: 102-2504
ggtagtgtagggacttcggcacgtgtgtcattccccgggatttctgtagtaaccctgcttctggtgaacttgtctggccggcattcatttaaggcctaaggatgaaggcgagaagaaataaaaaacagatcccaagctttcgcaagttaataaaaactagtaaagtcaaacttgaaaacaagctaaaaaataagcagtttaaacaacaaagcactctcaagaagtaccgaaaagaacagaggaaactaaggcaagctgtgaaagatgctgtgtctaagaaacccattccattggagaacccaaaggaaaagcgaccaggtaaaaggattgagagggaagaagaggaagaagaagaagcccttcctttagatatgatggatgaagatgacttacagttaatgaaggatttaggacaaagagtatcttttctaacaagagatctttcttctagtgagcctgttcatgcgaagaaacggaagcatgaacgcattatagataaatatgaaaaaataccaagaactctgcaaactgcaccagagaaggaactgattcatttacttcctatcaaagataaaagtggtataatcccacagactagggagaagccagttactgatagtaacaaagatgaagaggatcaagaagaagagagggaacttgaggaagagatcattgaagatcctattcaagagctgaccatagaagaacatttgattgagagaaagaagaaattacaggagaagaagatgcatattgcagccttggcatctgccatattatcagatccagaaaataatattaaaaaattgaaagaattacgttctatgttgatggaacaagatcctgatgtggctgttactgttcgaaagctggtaattgtttctctgatggagttatttaaagatattactccttcatataaaatccggcccctcacagaagcagaaaaatctactaagacccgaaaagaaacccagaagttaagagaatttgaagaaggcctggttagccaatacaagttttatttggaaaatctggaacaaatggttaaagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattgatatctgaaatgtgttgtgaagctgtgaagaaactctttaagcaagataaattaggccaagcttctcttggtgtaattaaagtgatttctggttttgtgaagggcagaaattacgaagttaggccagagatgttaaaaacatttttatgcctaagaatcaaggaagtagaagtgaaaaaagatacagaagacattaataaaccaaaaaaatttatgactttcaaagaaaagagaaaatctctatcaagaatgcagagaaagtggaagaaagcagaagagaaactagagcgagagcttcgagaggcagaagcttcagagagtactgagaaaaaacttaaactgcacacagagactctgaatattgtgtttgtaacctacttcagaatattgaagaaggcccagaggtcacctctcctgccagcagttctagaaggtcttgccaagtttgctcaccttataaatgtggaattttttgatgatctgttagtagttcttcatactctcattgagtctggtgacctaagctatcaagaaagtcttcactgtgtccagactgcttttcatattctttctggacaaggtgatgttctgaatattgatccattgaaattctacacacatctctacaaaacactgttcaaattacatgcaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatactttccccaaaacagatctactgcttgacagtgaatctcagggaagtggagttttccttcctgaactggatgagcctgagtactgcaatgctcagaacactgctctgtgggaactgcatgctctgcggaggcattatcatcccatagtgcagagatttgcagcccacctgatcgctggagcaccttctgaaggctctggagcactcaaaccagagttgagtcgaagatctgctactgaactttttgaggcatatagcatggcagaaatgacattcaatcctcctgttgaatcttcaaaccccaaaataaagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgcttccta

SEQ ID NO: 159961 - DNA, 1952 bp, Homo sapiens
  Payload ID: 11285
  Gene Symbol: NOCT
  Gene Name: nocturnin
  Uniprot ID: Q9UK39
  ENST ID: ENST00000280614
  CDS Start-End: 194-1489
ccgacgcagcggtgttgcacctccctctccggctctgctgcccgggatttccccagaacctgcgccgcgcgagaaggagcctgggagcatccgcccacactgcccggacagtcggctcgactcggtgccctcggccccagccgggctccgctcctcgggcgcgcgaggggccgtggtggcggcggcgcccggcatgtttcatagtccgcggcggctctgctcggccctgctgcagagggacgcgcccggcctgcgccgcctgcccgccccagggctgcgccgcccgttgtccccgccggctgctgttcccaggcccgcatccccccggctgctggcggcggcctcggcggcctcgggcgccgcgaggtcgtgttcccgaacagtgtgttccatgggaaccggtacaagcagactctatagtgctctcgccaagacactgaacagcagcgctgcctcccagcacccagagtatttggtgtcacctgacccagagcatctggagcccattgatcctaaagagcttcttgaggaatgcagggccgtcctgcacacccgacctccccggttccagagggattttgtggatctgaggacagattgccctagtacccacccacctatcagggttatgcaatggaacatcctcgcccaagctcttggagaaggcaaagacaactttgtacagtgccctgttgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtagaacacaacaatggaccagatggttgtgccttattttttcttcaaaaccgattcaagctagtcaacagtgccaatattaggctgacagccatgacattgaaaaccaaccaggtggccattgcacagaccctggagtgcaaggagtcaggccgacagttctgcatcgctgttacccatctaaaagcacgcactggctgggagcggtttcgatcagctcaaggctgtgacctccttcagaacctgcaaaacatcacccaaggagccaagattccccttattgtgtgtggggacttcaatgcagagccaacagaagaggtctacaaacactttgcttcctccagcctcaacctgaacagcgcctacaagctgctgagtgctgatgggcagtcagaacccccatacactacctggaagatccggacctcaggggagtgcaggcacaccctggattacatctggtattctaaacatgctctaaatgtaaggtcagctctcgatctgctcactgaagaacagattggacccaacaggttaccttccttcaattatccttcagaccacctgtctctagtgtgtgacttcagctttactgaggaatctgatggactttcataaatacttgcttttgtctttttaatcacaggagtctatttttttttttttttttttttttttgagacagagtctcgctctgttgcctaggctggagtacagtggcctgatctcggctcactgcaagatccgcctcccgggttcatggcattctcctgcctcagcctccagagcaactgggacaacaggcgcccgtcaccacgcccagctaattttttgtatttttagtagagacggggtttcaccgtgttagccaggatggtctcgatctcctgaccttgaatcacaagagtcttaacagggaatgtttcaggaaacaaataggataagacaatgccagaggaaggatagaaacatgggaagtttctatcatttcattttctgcgtttccagcatgcccttggaaaagactccctttagtccctttttcaattaaaacctatggtgaaaaaggcgtttgcactcc

SEQ ID NO: 159962 - DNA, 1572 bp, Homo sapiens
  Payload ID: 11285
  Gene Symbol: NOCT
  Gene Name: nocturnin
  ENST ID: ENST00000630479
  CDS Start-End: 187-690
agcggtgttgcacctccctctccggctctgctgcccgggatttccccagaacctgcgccgcgcgagaaggagcctgggagcatccgcccacactgcccggacagtcggctcgactcggtgccctcggccccagccgggctccgctcctcgggcgcgcgaggggccgtggtggcggcggcgcccggcatgtttcatagtccgcggcggctctgctcggccctgctgcagagggacgcgcccggcctgcgccgcctgcccgccccagggctgcgccgcccgttgtccccgccggctgctgttcccaggcccgcatccccccggctgctggcggcggcctcggcggcctcgggcgccgcgaggtcgtgttcccgaacagtgtgttccatgggaaccggtacaagcagactctatagtgctctcgccaagacactgaacagcagcgctgcctcccagcacccagagtatttggtgtcacctgacccagagcatctggagcccattgatcctaaagagcttcttgaggaatgcagggccgtcctgcacacccgacctccccggttccagagggattttgtggatctgaggacagattgccctagtacccacccacctatcagggttatgcaatggaacatcctcgcccaaggtatgctggatgcttttgtgcctctgcagtcaagtttgctgtgactgcctttctgcttctgcacatccacagtgcactgttttatgtggaaggaagaggtgtgggcagatggaggtgactgcagcagcatggagagctcctagaagaggttaagacagggaatcatctggttttcactttttttttttttttagaaagaaaaaagacactttaattgttcttggatagtctacaaacatggaaggtgtaaagaataaaccacgagttacttgctttaattgtaaaaaccaagtcaggtgcagtggctcacacctgtaatcccagcactttgggaggccgaggtgggtggatcacctgtggtcaggagttcgagaccagcctgaccaacatggagaaaccccgtttctactaaaaatacaaaattagccgggtgtggtggcgcatgcctgtaatcccagctactcgggaggctgaggcaggagaatcgcttgaacccagaaagtggtggttgcagtgagctgagattgcgccattgcactgcagcctgggctggagtacagtggcctgatctcggctcactgcaagatccgcctcccgggttcatggcattctcctgcctcagcctccagagcaactgggacaacaggcgcccgtcaccacgcccagctaattttttgtatttttagtagagacggggtttcaccgtgttagccaggatggtctcgatctcctgaccttgaatcacaagagtcttaacagggaatgtttcaggaaacaaataggataagacaatgccagaggaaggatagaaacatgggaagtttctatcatttcattttctgcgtttccagcatgcccttggaaaagactccctttagtccctttttcaattaaaacctatggtgaaaaaggcgtttgcactccaa

SEQ ID NO: 159963 - DNA, 1665 bp, Homo sapiens
  Payload ID: 11286
  Gene Symbol: NODAL
  Gene Name: nodal growth differentiation factor
  Uniprot ID: Q96S42
  ENST ID: ENST00000287139
  CDS Start-End: 1-1044
atgcacgcccactgcctgcccttccttctgcacgcctggtgggccctactccaggcgggtgctgcgacggtggccactgcgctcctgcgtacgcgggggcagccctcgtcgccatcccctctggcgtacatgctgagcctctaccgcgacccgctgccgagggcagacatcatccgcagcctacaggcagaagatgtggcagtggatgggcagaactggacgtttgcttttgacttctccttcctgagccaacaagaggatctggcatgggctgagctccggctgcagctgtccagccctgtggacctccccactgagggctcacttgccattgagattttccaccagccaaagcccgacacagagcaggcttcagacagctgcttagagcggtttcagatggacctattcactgtcactttgtcccaggtcaccttttccttgggcagcatggttttggaggtgaccaggcctctctccaagtggctgaagcaccctggggccctggagaagcagatgtccagggtagctggagagtgctggccgcggccccccacaccgcctgccaccaatgtgctccttatgctctactccaacctctcgcaggagcagaggcagctgggtgggtccaccttgctgtgggaagccgagagctcctggcgggcccaggagggacagctgtcctgggagtggggcaagaggcaccgtcgacatcacttgccagacagaagtcaactgtgtcggaaggtcaagttccaggtggacttcaacctgatcggatggggctcctggatcatctaccccaagcagtacaacgcctatcgctgtgagggcgagtgtcctaatcctgttggggaggagtttcatccgaccaaccatgcatacatccagagtctgctgaaacgttaccagccccaccgagtcccttccacttgttgtgccccagtgaagaccaagccgctgagcatgctgtatgtggataatggcagagtgctcctagatcaccataaagacatgatcgtggaagaatgtgggtgcctctgatgacatcctggagggagactggatttgcctgcactctggaaggctgggaaactcctggaagacatgataaccatctaatccagtaaggagaaacagagaggggcaaagttgctctgcccaccagaactgaagaggaggggctgcccactctgtaaatgaagggctcagtggagtctggccaagcacagaggctgctgtcaggaagagggaggaagaagcctgtgcagggggctggctggatgttctctttactgaaaagacagtggcaaggaaaagcacaagtgcatgagttctttactggattttttaaaaacctgtgaaccccccgaaactgtatgtgaaagttgagacatatgtgcatgtattttggaggtgggatgaagtcacctatagctttcatgtattctccaaagtagtctgtgtgtgacctgtccccctccccaaagattaaggatcactgtatagattaaaaagagtccgtcaatctcattgcctcaggctgggttgggggagccccacagctttctggctggccagtggcaatctactggccttgtccagaggctcactggagtggttctctgctaatgagctgtacaacaataaagccattgtctagtt

SEQ ID NO: 159964 - DNA, 1066 bp, Homo sapiens
  Payload ID: 11286
  Gene Symbol: NODAL
  Gene Name: nodal growth differentiation factor
  ENST ID: ENST00000414871
  CDS Start-End: 1-879
gaccaacagttggggatacagactaaagatgtggcagtggatgggcagaactggacgtttgcttttgacttctccttcctgagccaacaagaggatctggcatgggctgagctccggctgcagctgtccagccctgtggacctccccactgagggctcacttgccattgagattttccaccagccaaagcccgacacagagcaggcttcagacagctgcttagagcggtttcagatggacctattcactgtcactttgtcccaggtcaccttttccttgggcagcatggttttggaggtgaccaggcctctctccaagtggctgaagcaccctggggccctggagaagcagatgtccagggtagctggagagtgctggccgcggccccccacaccgcctgccaccaatgtgctccttatgctctactccaacctctcgcaggagcagaggcagctgggtgggtccaccttgctgtgggaagccgagagctcctggcgggcccaggagggacagctgtcctgggagtggggcaagaggcaccgtcgacatcacttgccagacagaagtcaactgtgtcggaaggtcaagttccaggtggacttcaacctgatcggatggggctcctggatcatctaccccaagcagtacaacgcctatcgctgtgagggcgagtgtcctaatcctgttggggaggagtttcatccgaccaaccatgcatacatccagagtctgctgaaacgttaccagccccaccgagtcccttccacttgttgtgccccagtgaagaccaagccgctgagcatgctgtatgtggataatggcagagtgctcctagatcaccataaagacatgatcgtggaagaatgtgggtgcctctgatgacatcctggagggagactggatttgcctgcactctggaaggctgggaaactcctggaagacatgataaccatctaatccagtaaggagaaacagagaggggcaaagttgctctgcccaccagaactgaagaggaggggctgcccactctgtaaatgaagggctcagtggagtctggccaagcaca

SEQ ID NO: 159965 - DNA, 4355 bp, Homo sapiens
  Payload ID: 11287
  Gene Symbol: NOMO1
  Gene Name: NODAL modulator 1
  Uniprot ID: Q15155
  ENST ID: ENST00000287667
  CDS Start-End: 172-3840
ctggggctgtgaacgtggggtcgaagcgcgcgtgcgcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctcatca

SEQ ID NO: 159966 - DNA, 666 bp, Homo sapiens
  Payload ID: 11287
  Gene Symbol: NOMO1
  Gene Name: NODAL modulator 1
  ENST ID: ENST00000565655
  CDS Start-End: 1-433
aagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccagggccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctc

SEQ ID NO: 159967 - DNA, 3765 bp, Homo sapiens
  Payload ID: 11287
  Gene Symbol: NOMO1
  Gene Name: NODAL modulator 1
  ENST ID: ENST00000610363
  CDS Start-End: 429-3731
gccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttg

SEQ ID NO: 159968 - DNA, 3921 bp, Homo sapiens
  Payload ID: 11287
  Gene Symbol: NOMO1
  Gene Name: NODAL modulator 1
  ENST ID: ENST00000620839
  CDS Start-End: 73-3876
gagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacccttcgtttgcaagaagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctc

SEQ ID NO: 159969 - DNA, 4352 bp, Homo sapiens
  Payload ID: 11287
  Gene Symbol: NOMO1
  Gene Name: NODAL modulator 1
  Uniprot ID: Q15155
  ENST ID: ENST00000619292
  CDS Start-End: 172-3840
ctggggctgtgaacgtggggtcgaagcgcgcgtgcgcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctca

SEQ ID NO: 159970 - DNA, 3765 bp, Homo sapiens
  Payload ID: 11287
  Gene Symbol: NOMO1
  Gene Name: NODAL modulator 1
  ENST ID: ENST00000620819
  CDS Start-End: 429-3731
gccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacccttcgtttgcaagaagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttg

SEQ ID NO: 159971 - DNA, 3921 bp, Homo sapiens
  Payload ID: 11287
  Gene Symbol: NOMO1
  Gene Name: NODAL modulator 1
  ENST ID: ENST00000620755
  CDS Start-End: 73-3876
gagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacccttcgtttgcaaggagagttccagttgacgtggtgtttggttccatggcggggtaccctagggattcatctgttttcttcacttccctttgcatctgagatcctgctggaaaccacagcaacctgtatccactattaggaggtaaaaatcaataaaatggcccattcatttgtgttgtagctc

SEQ ID NO: 159972 - DNA, 482 bp, Homo sapiens
  Payload ID: 11287
  Gene Symbol: NOMO1
  Gene Name: NODAL modulator 1
  ENST ID: ENST00000633436
  CDS Start-End: 1-433
aagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggg

SEQ ID NO: 159973 - DNA, 4352 bp, Homo sapiens
  Payload ID: 11288
  Gene Symbol: NOMO2
  Gene Name: NODAL modulator 2
  Uniprot ID: Q5JPE7
  ENST ID: ENST00000330537
  CDS Start-End: 172-3840
ctggggctgtgaacgtggcgtcgaagcgcgcgtgcgcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactcgctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggggtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattgttgcaacagggttcagtgtctgtggtcggatatcaatcattcgcttcccggacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccgacaggcccgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctca

SEQ ID NO: 159974 - DNA, 3911 bp, Homo sapiens
  Payload ID: 11288
  Gene Symbol: NOMO2
  Gene Name: NODAL modulator 2
  Uniprot ID: Q5JPE7
  ENST ID: ENST00000381474
  CDS Start-End: 67-3870
gcggcgtgcagtgtgaggggcgggacccggctgccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactcgctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggggtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattgttgcaacagggttcagtgtctgtggtcggatatcaatcattcgcttcccggacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccgacaggcccgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgta

SEQ ID NO: 159975 - DNA, 3765 bp, Homo sapiens
  Payload ID: 11288
  Gene Symbol: NOMO2
  Gene Name: NODAL modulator 2
  Uniprot ID: Q5JPE7
  ENST ID: ENST00000543392
  CDS Start-End: 429-3731
gccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactcgctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggggtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattgttgcaacagggttcagtgtctgtggtcggatatcaatcattcgcttcccggacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccgacaggcccgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttg

SEQ ID NO: 159976 - DNA, 682 bp, Homo sapiens
  Payload ID: 11288
  Gene Symbol: NOMO2
  Gene Name: NODAL modulator 2
  ENST ID: ENST00000562312
  CDS Start-End: 137-322
gcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactcgctcatcgagcaggtgcttaatatgcattgatgtgaatctgtacaaccacatgaaaaggagcggctctgtgtctacacctgaagaaaccgaacacgagcttgcccaaggccacacaacacgtggaagactcagatggcatttgggcatcttactgggttaacacttcgtgtctggtaatgctcagaatataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaa

SEQ ID NO: 159977 - DNA, 551 bp, Homo sapiens
  Payload ID: 11288
  Gene Symbol: NOMO2
  Gene Name: NODAL modulator 2
  ENST ID: ENST00000567831
  CDS Start-End: 1-242
agacgggctacatgctgagatgttccctgtctcacgccatcactctggtatgtacggcttatggagtctcttatttggaaaagcgctcgccttgtggatgtcaagaaagactaacatcccaggaatattgtaaacgtaggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcagg

SEQ ID NO: 159978 - DNA, 901 bp, Homo sapiens
  Payload ID: 11288
  Gene Symbol: NOMO2
  Gene Name: NODAL modulator 2
  ENST ID: ENST00000569051
  CDS Start-End: 1-671
tgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccgacaggcccgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggcgcagccctattgttcaggagagatgtgccctgggaccagcgagctaaagacccctaggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgag

SEQ ID NO: 159979 - DNA, 3765 bp, Homo sapiens; identical to SEQ ID NO: 159975
  Payload ID: 11288
  Gene Symbol: NOMO2
  Gene Name: NODAL modulator 2
  ENST ID: ENST00000564991
  CDS Start-End: 35-451

SEQ ID NO: 159980 - DNA, 3921 bp, Homo sapiens
  Payload ID: 11288
  Gene Symbol: NOMO2
  Gene Name: NODAL modulator 2
  Uniprot ID: Q5JPE7
  ENST ID: ENST00000621364
  CDS Start-End: 73-3876
gagcctgcggcgtgcagtgtgaggggcgggacccggctgccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactcgctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggggtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattgttgcaacagggttcagtgtctgtggtcggatatcaatcattcgcttcccggacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccgacaggcccgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctc

SEQ ID NO: 159981 - DNA, 1360 bp, Homo sapiens
  Payload ID: 11288
  Gene Symbol: NOMO2
  Gene Name: NODAL modulator 2
  ENST ID: ENST00000620440
  CDS Start-End: 1-849
atgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctc

SEQ ID NO: 159982 - DNA, 4252 bp, Homo sapiens
  Payload ID: 11288
  Gene Symbol: NOMO2
  Gene Name: NODAL modulator 2
  Uniprot ID: Q5JPE7
  ENST ID: ENST00000622306
  CDS Start-End: 73-3741
gagcctgcggcgtgcagtgtgaggggcgggacccggctgccggcggtgggtctagctgggggaggtcgggccatgctggtgggccagggcgcggggctgctggggcccgcggtggtcaccgccgcggtggtgctgctgctgagcggcgtggggccggcgcacggctcggaggacatcgtggtgggctgcggtggcttcgtcaagtcggacgtggagatcaactactcgctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggggtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattgttgcaacagggttcagtgtctgtggtcggatatcaatcattcgcttcccggacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccgacaggcccgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctc

SEQ ID NO: 159983 - DNA, 3911 bp, Homo sapiens
  Payload ID: 11289
  Gene Symbol: NOMO3
  Gene Name: NODAL modulator 3
  ENST ID: ENST00000263012
  CDS Start-End: 67-3870
gcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgta

SEQ ID NO: 159984 - DNA, 4356 bp, Homo sapiens
  Payload ID: 11289
  Gene Symbol: NOMO3
  Gene Name: NODAL modulator 3
  Uniprot ID: P69849
  ENST ID: ENST00000399336
  CDS Start-End: 173-3841
ctggggctgtgaccgtggggtcgaagcgcgcgtgcgcggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcatca

SEQ ID NO: 159985 - DNA, 3765 bp, Homo sapiens
  Payload ID: 11289
  Gene Symbol: NOMO3
  Gene Name: NODAL modulator 3
  ENST ID: ENST00000575225
  CDS Start-End: 35-451
gccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttg

SEQ ID NO: 159986 - DNA, 516 bp, Homo sapiens
  Payload ID: 11289
  Gene Symbol: NOMO3
  Gene Name: NODAL modulator 3
  ENST ID: ENST00000576460
  CDS Start-End: 1-286
tgaggattggtgctggaagaacaagagcctggaggtggaagtgctggaggatgacgtgtctgcagttgagttcaggcagacgggctacatgctgagatgttccctgtctcacgccatcactctggtgcagccctattgttcaggagagatgtgccctgggaccagcgagctaaagacccctcggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgag

SEQ ID NO: 159987 - DNA, 320 bp, Homo sapiens
  Payload ID: 11289
  Gene Symbol: NOMO3
  Gene Name: NODAL modulator 3
  ENST ID: ENST00000570346
  CDS Start-End: 1-152
gatcctacattgccctgccattgacgctgctggttctgctggccggttacaaccatgacaagggacatattaggcccggagagaggccagcccatccctggggactcattagtaagaggcctgcctcgtttgaactgaaacccacccattagcacgtggcagctgctgatcatgtctgaagaagctcattcctttgctgctgcagttgacaagccggctacagggagtcggcgcgctcggccaggcagcctctgacaatagcggcccagaagatgcaaagagacaagccaagaaacagaagacaaggcggacgtgaggag

SEQ ID NO: 159988 - DNA, 683 bp, Homo sapiens
  Payload ID: 11289
  Gene Symbol: NOMO3
  Gene Name: NODAL modulator 3
  ENST ID: ENST00000576589
  CDS Start-End: 138-323
gcggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagcaggtgcttaatatgcattgatgtgaatctgtacaaccacatgaaaaggagtggctctatgtctgcacctgaagaaaccgaacacgagcttgcccaaggccacgcaacacgtggaagactcagatggcatttgggcatcttactgggttaacacttcgtgtctggtaatgctcagaatataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaa

SEQ ID NO: 159989 - DNA, 551 bp, Homo sapiens
  Payload ID: 11289
  Gene Symbol: NOMO3
  Gene Name: NODAL modulator 3
  ENST ID: ENST00000572033
  CDS Start-End: 1-242
agacgggctacatgctgagatgttccctgtctcacgccatcactctggtatgtacggcttatggagtctcttatttggaaaagcgcttgccttgtggatgtcaagaaagactaacatcccaggaatattgtaaacgtaggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcagg

SEQ ID NO: 159990 - DNA, 3765 bp, Homo sapiens
  Payload ID: 11289
  Gene Symbol: NOMO3
  Gene Name: NODAL modulator 3
  ENST ID: ENST00000619364
  CDS Start-End: 35-451
gccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttg

SEQ ID NO: 159991 - DNA, 4356 bp, Homo sapiens
  Payload ID: 11289
  Gene Symbol: NOMO3
  Gene Name: NODAL modulator 3
  Uniprot ID: P69849
  ENST ID: ENST00000611106
  CDS Start-End: 173-3841
ctggggctgtgaccgtggggtcgaagcgcgcgtgcgcggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcatca

SEQ ID NO: 159992 - DNA, 3911 bp, Homo sapiens
  Payload ID: 11289
  Gene Symbol: NOMO3
  Gene Name: NODAL modulator 3
  ENST ID: ENST00000616708
  CDS Start-End: 67-3870
gcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgta

SEQ ID NO: 159993 - DNA, 516 bp, Homo sapiens; identical to SEQ ID NO: 159986
  Payload ID: 11289
  Gene Symbol: NOMO3
  Gene Name: NODAL modulator 3
  ENST ID: ENST00000633153
  CDS Start-End: 1-286

SEQ ID NO: 159994 - DNA, 551 bp, Homo sapiens
  Payload ID: 11289
  Gene Symbol: NOMO3
  Gene Name: NODAL modulator 3
  ENST ID: ENST00000634143
  CDS Start-End: 1-242
agacgggctacatgctgagatgttccctgtctcacgccatcactctggtatgtacggcttatggagtctcttatttggaaaagcgcttgccttgtggatgtcaagaaagactaacatcccaggaatattgtaaacgtaggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcccgtgcagg

SEQ ID NO: 159995 - DNA, 320 bp, Homo sapiens; identical to SEQ ID NO: 159987
  Payload ID: 11289
  Gene Symbol: NOMO3
  Gene Name: NODAL modulator 3
  ENST ID: ENST00000632143
  CDS Start-End: 1-152

SEQ ID NO: 159996 - DNA, 683 bp, Homo sapiens; identical to SEQ ID NO: 159988
  Payload ID: 11289
  Gene Symbol: NOMO3
  Gene Name: NODAL modulator 3
  ENST ID: ENST00000633882
  CDS Start-End: 138-323

SEQ ID NO: 159997 - DNA, 1892 bp, Homo sapiens
  Payload ID: 11290
  Gene Symbol: NOG
  Gene Name: noggin
  Uniprot ID: Q13253
  ENST ID: ENST00000332822
  CDS Start-End: 526-1224
aaaccggtgccaacgtgcgcggacgccgccgccgccgccgccgctggagtccgccgggcagagccggccgcggagcccggagcaggcggagggaagtgcccctagaaccagctcagccagcggcgcttgcacagagcggccggacgaagagcagcgagaggaggaggggagagcggctcgtccacgcgccctgcgccgccgccggcccgggaaggcagcgaggagccggcgcctcccgcgccccgcggtcgccctggagtaatttcggatgcccagccgcggccgccttccccagtagacccgggagaggagttgcggccaacttgtgtgcctttcttccgccccggtgggagccggcgctgcgcgaagggctctcccggcggctcatgctgccggccctgcgcctgcccagcctcgggtgagccgcctccggagagacgggggagcgcggcggcgccgcgggctcggcgtgctctcctccggggacgcgggacgaagcagcagccccgggcgcgcgccagaggcatggagcgctgccccagcctaggggtcaccctctacgccctggtggtggtcctggggctgcgggcgacaccggccggcggccagcactatctccacatccgcccggcacccagcgacaacctgcccctggtggacctcatcgaacacccagaccctatctttgaccccaaggaaaaggatctgaacgagacgctgctgcgctcgctgctcgggggccactacgacccaggcttcatggccacctcgccccccgaggaccggcccggcgggggcgggggtgcagctgggggcgcggaggacctggcggagctggaccagctgctgcggcagcggccgtcgggggccatgccgagcgagatcaaagggctagagttctccgagggcttggcccagggcaagaagcagcgcctaagcaagaagctgcggaggaagttacagatgtggctgtggtcgcagacattctgccccgtgctgtacgcgtggaacgacctgggcagccgcttttggccgcgctacgtgaaggtgggcagctgcttcagtaagcgctcgtgctccgtgcccgagggcatggtgtgcaagccgtccaagtccgtgcacctcacggtgctgcggtggcgctgtcagcggcgcgggggccagcgctgcggctggattcccatccagtaccccatcatttccgagtgcaagtgctcgtgctagaactcgggggccccctgcccgcacccggacacttgatcgatccccaccgacgccccctgcaccgcctccaaccagttccaccaccctctagcgagggttttcaatgaacttttttttttttttttttttttttttctgggctacagagacctagctttctggttcctgtaatgcactgtttaactgtgtaggaatgtatatgtgtgtgtatatacggtcccagttttaatttacttattaaaaggtcagtattatacgttaaaagttaccggcttctactgtatttttaaaaaaaagtaagcaaaagaaaaaaaaaagaacagagaaaagagagacttattctggttgttgctaataatgttaacctgctatttatattccagtgcccttcgcatggcgaagcaggggggaaaagttatttttttcttgaagtacaaagagacgggggaacttttgtagaggactttttaaaagctattttccattcttcggaaagtgttttggttttccttggacctcgaagaagctatagagttcaatgttattttacagttattgtaaatatagagaacaaatggaatgactaatcattgtaaattaagagtatctgctatttattctttataatatcccgtgtagtaaatgagaaagaagtgcagagcaggatt

SEQ ID NO: 159998 - DNA, 6567 bp, Homo sapiens
  Payload ID: 11291
  Gene Symbol: NIPA1
  Gene Name: non imprinted in Prader-Willi/Angelman syndrome 1
  Uniprot ID: Q7RTP0
  ENST ID: ENST00000337435
  CDS Start-End: 26-1015
ggctcggagggcgggcgcgggcggaatggggactgcagctgcggcagcggcggcggcggcggcggcggcggccggggagggggcgcgtagcccgagccccgccgccgtgtcgctcggcctgggcgtggccgtcgtgtcgagcctggtgaacgggtccacgttcgtgctacagaagaagggcatcgtgcgtgccaagcggcgaggtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagttacaaatgtataaggcagttagaaataatacagtcacatgtcacttaatgatagggaaacattctgagaaatgcattgtaaggtgactttattgtgtgaacatcatggagtgcacttatacaaacctagatgggacacctatgacccacccaggccagatggtacagcctgttgctcctgggccacacacctgtacagcatgtgaccgcactgaataccgcaggcaattgtaacacagtggtgagtatttgtgtttacaaacataggaaaggtacagtaaaactatggtattacaatgttatgggaccaccgtcatgtaagtggtatgtctttgacagaaacatggttacgtggttcatgactgtatattcactggaagatagtcaagactaaagacacattagagcaaattgacccctttaacatgtgattattgtccaattaaagacagttgatttaagtagcatgaggtattattttatttgtattcgatctgtgttacctgggatccagtatcaaatatatccacattctttatcagcaagcattcatggccattcagaagaaataaattaggtaacttgataataaggctaagtgggagagtacctgttcaatagctcatatatcgagtaccctgtcatacaggaacaagttaaaggacacaattgaggttaggctagcttctacaaattgcaatatgcagtttttgaaagattttctaacaaaaagccaataaatgtagccatctccttgttgtttgcaatggcagagcatcctagagttcctcagctaacctctcattatgtgtcttaaatgcaaaagagccattaattatgccagtatttgaatcaaagaggtcattctctgtctatagtgttcccatccatgtgttccaaatgggagcatagcatgaagtgatgcacatatttcaccacggtatcatgtacttcatggccagtgttttatctcagcagggaactacgccaagttgaaagatggggttgggtaaagtagattaggtgaagtagaacataaaattgaatagtacccaattaaagttcctcagtaagaaaaaaaatgtgtttttgtaggcaaaaagaacatttctaaagtctcaaggaatagcttcctaaagtgttgagtaaagaggctaaataaaatgagactagtttaatatagagagaaaaatacctttatggagtaaacgtgtacatgatgatcatgggttgtcagtgatttgtgaactgagagcagcaacaacattattttttaaaaatcttaaatcctctcaatggatggttaacaaatgctcaaagtccattactctttttattggctcttgcaggttttgtgttttatcatcagtgcttttagaaatgcaggccttaacttactgaactgaactttctgaaaacgtaatgtagcagtatcaatatacttttgggcataaaaatagtttcctaggtaaggggtgtgagatattcaaagaatacatgtggctaacaagtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttgaaaatgaaaaagccccaaagtgagaactttgggggagggcctagaacatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcctgttctgctcattgatcaaaggtagggccaattaaggattctaaccctaacccagcaccacaaagcccccctggagcatcttcccggctggcaggaccatgccatctctgtggagaaggtgctggggagggaagtccttccagtgccacatggagtgaggccctgcccatgctggggactttggggaggaatttggtattctggtggccttgctcagctctcattgagatcttttcctatcagaatgttagtgaatatacttcgcagctctttgttcagcaataaggaatattctttcaattcctgctcttcaagccaatttactacacccagttgtctttccagaagttcatcccagcggtaatatgttggtgtttgttcttctttggatttcacatctgttttctggtagaagtgagcactgttcacttgtgcagtcgtcttattttccttcttcctagatgactcagctctttgtaaatgttgtgctcaacttctaggggccagttctagactttggagatgcagtgtctcccaggtgtgcacggacacctggtccgtggaaacaggtgtgatgggcacaggctgctgcccttctgtctggtcgggggattcctcttcttcaagctgctcagctaacccagaagaggggagagagtactccggtggttcccagagcccctcccgttgtgccgcttcgacctgacacctgctcgatgctgacttaggcttcctgccaccaagcaggaaactagaaagagaacatttcagtgtaaggtctgttcccgacagcatggattagcttccgtgttctgaagttgttcttttcatggtgtctgacaccgagggcgttgttcgtccatcaggcgggattggatggagtcttggtgttttgccttctcagggaccaaaaatgtatcattgactccttaacagtgaccttcctcccaaggacatatccgtgttcatttttcataggttttactcatattcataggtagattctgttaatgtgagttggaaagaaaagaccaatttgtacaccagtcacaccacaagacagtttatcatataaaatacctcaattttttgtattcctcatttccacctcacaattgtactggtgatgaattttaagggtctgtcctttagcttataggtgatgtttcacatctggccagattcttatacctccattgtatacttgaaaaggttcagaattacaggaacagcagtgagaatttggcccactaccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttgttttaaaagaaagggttttatatgttctattgtaaaatatggaaattaaacagggacttcagaaagccgcacagaaagatcaccttccgatggtgtgatgtgctcctgacattcggccgaggtctgtattctgaaaaagatttaatggcctgtgaaacacgtggattctgttgcactggatttgtaataaatgacgctgaacttcctgcttccaagcagctcaaccctgatgctgaactgacaccaggcgaatgtcagggctcccaaaccactagtgccaaagggtcatgttgaaaagttcagaatatttatttgtcagaatataataattgccccccaccttagtatttttgcactttacagaaatttagatactgtttttcagtggcttgagcgttttgccttttcaaaggataactattattttcttgaaaatggaatataatcatgagaggaagaagatgtaaaaaatgtcaaatgttgattggttgtgtaaaagttttgtcatagacatgtattggggagcttccaattagcatacatagacacatgtgtcagtggccaagacctgcttatattttgctttatagatgtagtcatagcatgttgttattgcctcatgtaaataaaaaggctattaagttttccagtaatatttattaatctgtatgtgttttaaaataaaataacttatttctagctgaaca

SEQ ID NO: 159999 - DNA, 7613 bp, Homo sapiens
  Payload ID: 11291
  Gene Symbol: NIPA1
  Gene Name: non imprinted in Prader-Willi/Angelman syndrome 1
  Uniprot ID: Q7RTP0
  ENST ID: ENST00000437912
  CDS Start-End: 1299-2063
gcaaagtgccaggaatgatgcaggcagcctgccagatccttggaatcttctggaatgagagaggttgagctgcagcccaaaggcctgtgaaagtgccaggttgaagggtgacggggtgcccagattcccaccttcaaatttcctggcagcatcctggctgtcatggagcgctgtctccagttcagttttctgacacataaggattcgtatggtatgatcctgggcctttgggagacaagaaaagcaagtgctgaaagagaagcaaagaaaccttctccagaggacaggagggaacttcacaccctccactcacctctagctgcctccttagggcttgctgatgttggtggcttgccttcttttcctatagaaaagaagaggaagacagagctcttactagagggaggcagagatggcacagcaagagacatgcccccagcatggcaccactgtcccaggacaggcccacccatgggaccaggttatcagggaccctgtggggatggggtggaagctgggaggtgagccttcctccccaggctgggagtaggcgagacgagactggggcctctacatctgagtgccccccaaacccagcggtcatgtcgtgagcaaagaaagaaaccatgttacctctttcagctgagctccgttctgttgtttctgtggggagagtcaaaggaaggtgactgagggtggcccctcgactctattgcccaggccaggaagcggtacgcaggggtcaggaatggattttaagggcaaagttctcagacccaatgggaacacaaactggtcaacttgccttaacgcccaaagaaaaaggatttgggtctttgttggtttttgcccacagccacagaactgaaagtctgaaactagattctctggaaaagacagtaacataaaccttccgacataagagtgtgagaaaagcccacccttctgccagcttgtgatggagaaagatgtgttcattcaacaagcattgagcaagcacataggggccggggacagttcttcacagctgggatataggacggaaaaggcagacaggagcccttggccccaaggtttccattctagtgaatctttaaatctcagactctcagagcaaacagaaccctctgatactctaactctacctcctcaggaaacggaagcccaaagaggaggggagcttacagcaggccctggactagggattaacacaaaaacaacagcaacaaatctgatttaagcttcacacatgtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagttacaaatgtataaggcagttagaaataatacagtcacatgtcacttaatgatagggaaacattctgagaaatgcattgtaaggtgactttattgtgtgaacatcatggagtgcacttatacaaacctagatgggacacctatgacccacccaggccagatggtacagcctgttgctcctgggccacacacctgtacagcatgtgaccgcactgaataccgcaggcaattgtaacacagtggtgagtatttgtgtttacaaacataggaaaggtacagtaaaactatggtattacaatgttatgggaccaccgtcatgtaagtggtatgtctttgacagaaacatggttacgtggttcatgactgtatattcactggaagatagtcaagactaaagacacattagagcaaattgacccctttaacatgtgattattgtccaattaaagacagttgatttaagtagcatgaggtattattttatttgtattcgatctgtgttacctgggatccagtatcaaatatatccacattctttatcagcaagcattcatggccattcagaagaaataaattaggtaacttgataataaggctaagtgggagagtacctgttcaatagctcatatatcgagtaccctgtcatacaggaacaagttaaaggacacaattgaggttaggctagcttctacaaattgcaatatgcagtttttgaaagattttctaacaaaaagccaataaatgtagccatctccttgttgtttgcaatggcagagcatcctagagttcctcagctaacctctcattatgtgtcttaaatgcaaaagagccattaattatgccagtatttgaatcaaagaggtcattctctgtctatagtgttcccatccatgtgttccaaatgggagcatagcatgaagtgatgcacatatttcaccacggtatcatgtacttcatggccagtgttttatctcagcagggaactacgccaagttgaaagatggggttgggtaaagtagattaggtgaagtagaacataaaattgaatagtacccaattaaagttcctcagtaagaaaaaaaatgtgtttttgtaggcaaaaagaacatttctaaagtctcaaggaatagcttcctaaagtgttgagtaaagaggctaaataaaatgagactagtttaatatagagagaaaaatacctttatggagtaaacgtgtacatgatgatcatgggttgtcagtgatttgtgaactgagagcagcaacaacattattttttaaaaatcttaaatcctctcaatggatggttaacaaatgctcaaagtccattactctttttattggctcttgcaggttttgtgttttatcatcagtgcttttagaaatgcaggccttaacttactgaactgaactttctgaaaacgtaatgtagcagtatcaatatacttttgggcataaaaatagtttcctaggtaaggggtgtgagatattcaaagaatacatgtggctaacaagtgtaatgagaaagttcatgtgtcacatgaaaatgatcatgtttgtgttgctacagcttttgtgggaaatttagtttaaaggcagctcttggtgtaccttagtatattttaatccacaattataccattgatactgagaggtgatacccgatgatcttctctataatattcttagagtaaaacaaaatctcaaaagtattaatagctcttctacccttgaaggtgactggtcctgggacagttagaatctttcaggtttacctctgttcagcagatacttcagtaggatacatagcttttcttccagtgaaacaaagttcatatcatccattgtttttcaagcacgtgacaccagcctcaaagtaaatgacatgaccagtggttgaacagtctaattttcaaatttaatatagagcatataacttctgatttgatagtatttattttaaaaaattatgttttcatcattcatttgaaaatgaaaaagccccaaagtgagaactttgggggagggcctagaacatggatagatctcttagtggtctttccaaaagtacatgtacttgaaatattttcattatcatactattctttgaaaaaaaagatgcttactgtatacttgttttcaagcatcctctaaaatcaaaggttttgatcacaatatgcagatttctcttgatagatacttaaataggctatttctctcctcttcttgggcaatgccttgttttctcctctgaatatttgcatttgaaaggattgcttcctgttctgctcattgatcaaaggtagggccaattaaggattctaaccctaacccagcaccacaaagcccccctggagcatcttcccggctggcaggaccatgccatctctgtggagaaggtgctggggagggaagtccttccagtgccacatggagtgaggccctgcccatgctggggactttggggaggaatttggtattctggtggccttgctcagctctcattgagatcttttcctatcagaatgttagtgaatatacttcgcagctctttgttcagcaataaggaatattctttcaattcctgctcttcaagccaatttactacacccagttgtctttccagaagttcatcccagcggtaatatgttggtgtttgttcttctttggatttcacatctgttttctggtagaagtgagcactgttcacttgtgcagtcgtcttattttccttcttcctagatgactcagctctttgtaaatgttgtgctcaacttctaggggccagttctagactttggagatgcagtgtctcccaggtgtgcacggacacctggtccgtggaaacaggtgtgatgggcacaggctgctgcccttctgtctggtcgggggattcctcttcttcaagctgctcagctaacccagaagaggggagagagtactccggtggttcccagagcccctcccgttgtgccgcttcgacctgacacctgctcgatgctgacttaggcttcctgccaccaagcaggaaactagaaagagaacatttcagtgtaaggtctgttcccgacagcatggattagcttccgtgttctgaagttgttcttttcatggtgtctgacaccgagggcgttgttcgtccatcaggcgggattggatggagtcttggtgttttgccttctcagggaccaaaaatgtatcattgactccttaacagtgaccttcctcccaaggacatatccgtgttcatttttcataggttttactcatattcataggtagattctgttaatgtgagttggaaagaaaagaccaatttgtacaccagtcacaccacaagacagtttatcatataaaatacctcaattttttgtattcctcatttccacctcacaattgtactggtgatgaattttaagggtctgtcctttagcttataggtgatgtttcacatctggccagattcttatacctccattgtatacttgaaaaggttcagaattacaggaacagcagtgagaatttggcccactaccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttgttttaaaagaaagggttttatatgttctattgtaaaatatggaaattaaacagggacttcagaaagccgcacagaaagatcaccttccgatggtgtgatgtgctcctgacattcggccgaggtctgtattctgaaaaagatttaatggcctgtgaaacacgtggattctgttgcactggatttgtaataaatgacgctgaacttcctgcttccaagcagctcaaccctgatgctgaactgacaccaggcgaatgtcagggctcccaaaccactagtgccaaagggtcatgttgaaaagttcagaatatttatttgtcagaatataataattgccccccaccttagtatttttgcactttacagaaatttagatactgtttttcagtggcttgagcgttttgccttttcaaaggataactattattttcttgaaaatggaatataatcatgagaggaagaagatgtaaaaaatgtcaaatgttgattggttgtgtaaaagttttgtcatagacatgtattggggagcttccaattagcatacatagacacatgtgtcagtggccaagacctgcttatattttgctttatagatgtagtcatagcatgttgttattgcctcatgtaaataaaaaggctattaagttttccagtaatatttattaatctgtatgtgttttaaaataaaataacttatttctagctgaa

SEQ ID NO: 160000 - DNA, 2799 bp, Homo sapiens
  Payload ID: 11291
  Gene Symbol: NIPA1
  Gene Name: non imprinted in Prader-Willi/Angelman syndrome 1
  ENST ID: ENST00000559448
  CDS Start-End: 1-271
gtcgagcctggtgaacgggtccacgttcgtgctacagaagaagggcatcgtgcgtgccaagcggcgaggtacttcctatttaacagacattgtgtggtgggctggcacaatcgcaatggctgttggccagattggaaacttcctggcttacacggcggtccccacggtcctggtaacccccctgggcgcccttggagtaccgttcggacagatgcccaaatccttgcagagaagtgtgtccatgatgggtgtattgaagtttacaccttagagtcacgtaggcattaaggtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtttttaatcctctgacaagttgactcttcgacccccacccccacccaagacattttaatagtaaatagagagagagagaagagttaatgaacatgaggtagtgttccactggcaggatgacttttcaatagctcaaatcaatttcagtgcctttatcacttgaattattaacttaatttgactcttaatgtgtatatgttcttagattagaataatgcaacttcgagtatgctttaatatttcaatattcaagttacaaatgtataaggcagttagaaataatacagtcacatgtcacttaatgatagggaaacattctgagaaatgcattgtaaggtgactttattgtgtgaacatcatggagtgcacttatacaaacctagatgggacacctatgacccacccaggccagatggtacagcctgttgctcctgggccacacacctgtacagcatgtgaccgcactgaataccgcaggcaattgtaacacagtggtgagtatttgtgtttacaaacataggaaaggtacagtaaaactatggtattacaatgttatgggaccaccgtcatgtaagtggtatgtctttgacagaaacatggttacgtggttcatgactgtatattcactggaagatagtcaagactaaagacacattagagcaaattgacccctttaacatgtgattattgtccaattaaagacagttgatttaagtagcatgaggtattattttatttgtattcgatctgtgttacctgggatccagtatcaaatatatccacattctttatcagcaagcattcatggccattcagaagaaataaattaggtaacttgataataaggctaagtgggagagtacctgttcaatagctcatatatcgagtaccctgtcatacaggaacaagttaaaggacacaattgaggttaggctagcttctacaaattgcaatatgcagtttttgaaagattttctaacaaaaagccaataaatgtagccatctccttgttgtttgcaatggcagagcatcctagagttcctcagctaacctctcattatgtgtcttaaatgcaaaagagccattaattatgccagtatttgaatcaaagaggtcattctctgtctatagtgttcccatccatgtgttccaaatgggagcatagcatgaagtgatgcacatatttcaccacggtatcatgtacttcatggccagtgttttatctcagcagggaactacgccaagttgaaagatggggttgggtaaagtagattaggtgaagtagaacataaaattgaatagtacccaattaaagttcctcagtaa

SEQ ID NO: 160001 - DNA, 1675 bp, Homo sapiens
  Payload ID: 11291
  Gene Symbol: NIPA1
  Gene Name: non imprinted in Prader-Willi/Angelman syndrome 1
  Uniprot ID: Q7RTP0
  ENST ID: ENST00000561183
  CDS Start-End: 398-1162
acccttctcctggctcagcctcccgagtagctgggactacaggcctccgccacgacgcccagctaattttttgtatttttagtagagacggggtttcactgtgttagccaggatggtctcgatctcctgaccttgtgatccacccgcctcggcctcccgaagtgctgggattacaggcgtgagccaccgcgcccggcttgttgtagtttattaaaacgaggaaactagactatgggatcacaagcccagagccccatgtagctgactctagcgccaagggcggaagagaaacgcccagcgccagggctctccttcgatctctgcagcggcgcgccgggcttcgcgctccggtacttcctatttaacagacattgtgtggtgggctggcacaatcgcaatggctgttggccagattggaaacttcctggcttacacggcggtccccacggtcctggtaacccccctgggcgcccttggagtaccgttcgggtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtccagtcagagagccctctgcctgtgcctggtactcctggccgtgctcggctgcagcatcatcgtccagttcaggtacatcaacaaggcgctggagtgcttcgactcctcggtgttcggggccatctactacgtcgtgtttaccacgctggtcctgctggcctcagccatcctcttccgggagtggagcaacgtgggcctggtggacttcttggggatggcctgtggattcacgaccgtctccgtggggattgtccttatacaggtgttcaaagagttcaatttcaaccttggggagatgaacaaatctaatatgaaaacagactagattgcaataggagcttggatggttcgaggaataggcattggaggtggtttctggccgtgattggatgtgaagtagaagaggtcctcgatcatggtgttagaattgactggatagtaacaggtggtctggtggatagcggggagcatggctcagcaccagagcagaggcccagccagccctctgcagcccaaacgtccccaacggttgcctggcaccatctctctctgatgagacgaatctcattttcatttccattaacctggaagctttcatgaatattctcttcttttaaaacattttaacattatttaaacagaaaaagatgggctctttctggttagttgttacatgatagcagagatatttttacttagattactttgggaatgagagattgttgtcttgaactctggcactgtacagtgaatgtgtctgtagttgtgttagtttgcattaagcatgtataacattcaagtatgtcatccaaataagaggcatatacattgaattgtt

SEQ ID NO: 160002 - DNA, 582 bp, Homo sapiens
  Payload ID: 11291
  Gene Symbol: NIPA1
  Gene Name: non imprinted in Prader-Willi/Angelman syndrome 1
  ENST ID: ENST00000557930
  CDS Start-End: 1-177
atcgtgcgtgccaagcggcgaggtacttcctatttaacagacattgtgtggtgggctggcacaatcgcaatggctgttggccagattggaaacttcctggcttacacggcggtccccacggtcctggtaacccccctgggcgcccttggagtaccgttcgggtgttactcactgtaggaaccatgtcagatggtgttctggataaaaagcctgtcttcaacttggaatcccagtccattttagcttcctatctcctgaaggaaaagctcaacatcttgggcaagttggggtgcctgctaagctgtgcaggctccgtcgtgctgattatccactccccaaagtctgagagtgtgacaactcaggctgagctggaggaaaagctgaccaatccagtgtttgtgggctacctgtgcatcgtgctgctcatgctgctgctgctcatcttctggatcgcgccggcccatgggcccaccaacatcatggtctacatcagcatctgctccttgctgggcagtttcaccgtgccttccaccaagggcatcgggctggcggcccaagacatcttgcataacaacccgtcca

SEQ ID NO: 160003 - DNA, 3233 bp, Homo sapiens
  Payload ID: 11292
  Gene Symbol: NIPA2
  Gene Name: non imprinted in Prader-Willi/Angelman syndrome 2
  Uniprot ID: Q8N8Q9
  ENST ID: ENST00000337451
  CDS Start-End: 614-1696
gttttccggcgccggccctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaaca

SEQ ID NO: 160004 - DNA, 1531 bp, Homo sapiens
  Payload ID: 11292
  Gene Symbol: NIPA2
  Gene Name: non imprinted in Prader-Willi/Angelman syndrome 2
  Uniprot ID: Q8N8Q9
  ENST ID: ENST00000359727
  CDS Start-End: 506-1531
aggttttccggcgccggccctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtgaggtcgccactccttcctttcaggctctcccggctgtgatagaccttcagttacagagagagggagcagagtgggaccaggtctgagaatagtgaagcaactcattcctttcaggacattccctctgatgtcctattttcaaactgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcagtgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaa

SEQ ID NO: 160005 - DNA, 2280 bp, Homo sapiens
  Payload ID: 11292
  Gene Symbol: NIPA2
  Gene Name: non imprinted in Prader-Willi/Angelman syndrome 2
  Uniprot ID: Q8N8Q9
  ENST ID: ENST00000398013
  CDS Start-End: 329-1411
gcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaa

SEQ ID NO: 160006 - DNA, 3130 bp, Homo sapiens
  Payload ID: 11292
  Gene Symbol: NIPA2
  Gene Name: non imprinted in Prader-Willi/Angelman syndrome 2
  Uniprot ID: Q8N8Q9
  ENST ID: ENST00000398014
  CDS Start-End: 511-1593
gtcatttagccgcgcctaggttttccggcgccggccctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctggagctactcggccagggtttaagactttaaatgagaataaagggtggtatttacgaggaaatgagagtgaataagtcatctctaacctctcccagcctttttttcataagagagaccatattaaacttacatgtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtggtgggctggactgctgtcaatgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaaca

SEQ ID NO: 160007 - DNA, 1412 bp, Homo sapiens
  Payload ID: 11292
  Gene Symbol: NIPA2
  Gene Name: non imprinted in Prader-Willi/Angelman syndrome 2
  Uniprot ID: Q8N8Q9
  ENST ID: ENST00000539711
  CDS Start-End: 318-1343
gacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggtttgaagactgcttcattctgcctctagtaccagcggtttctctgttctgtgatcaatgtgattcacaggaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcagtgggagctggtgaggtggccaacttcgctgcgtatgcgtttgcaccagccactctagtgactccactaggagctctcagcgtgctagtaagtgccattctttcttcatactttctcaatgaaagacttaatcttcatgggaaaattgggtgtttgctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctg

SEQ ID NO: 160008 - DNA, 554 bp, Homo sapiens
  Payload ID: 11292
  Gene Symbol: NIPA2
  Gene Name: non imprinted in Prader-Willi/Angelman syndrome 2
  ENST ID: ENST00000560039
  CDS Start-End: 378-554
gcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaagccgcgcggccggccggccgactagggctctcccggctgtgatagaccttcagttacagagagagggagcagagtgggaccaggtctgagaatagtgaagcaactcattcctttcaggacattccctctgatgtcctattttcaaactgaactccttaagtaacaaacgaaatgagccaggggcgtggaaaatatgacttctatattggtctgggattggctatgagctccagcattttcattggaggaagtttcattttgaaaaaaaagggcctccttcgacttgccaggaaaggctctatgagagcaggtcaaggtggccatgcatatcttaaggaatggttgtgg

SEQ ID NO: 160009 - DNA, 3953 bp, Homo sapiens
  Payload ID: 11293
  Gene Symbol: NCMAP
  Gene Name: noncompact myelin associated protein
  Uniprot ID: Q5T1S8
  ENST ID: ENST00000374392
  CDS Start-End: 67-375
gaccctggctgggagcgcggcggtgccggcgggaggccgagcggggctcgacagagcaggatcgagatgaccacagccacccctctgggggataccaccttcttctcactgaacatgaccaccaggggagaagacttcctgtataagagttctggagccattgttgctgccgttgtggtggttgtcatcatcatcttcaccgtggttctgatcctgctgaagatgtacaacaggaaaatgaggacgaggcgggaactagagcccaagggccccaagccaaccgccccttctgccgtgggcccaaacagcaacggcagccaacacccagcaactgtgaccttcagtcctgttgacgtccaggtggagacgcgatgacctctaccctggcgctatctccaccactgtccaaagagcctctccagagtcaagacccagaggcacactctctggcagcttcacaatgagcttcttctggtcaggtcgacagagacatctttgacgcaatctctgatgcttccagcaatcctcaaccttgtctgccctgccctaccccaactgtgtccacatccctgccgccaccccaccaaaaagctgcagaacattcttttgtcatctgatgaggtagagctatgttgggaatccaccaatgtgggcttggctttcccccacactgtagttagacagatagacagatagcccaggagccaggtgtcagggagcactgctgagagtatcacaataggatctgtcacggggttcatatcagatgaagcgccgtatccactgcttcacagagcaaaacattcaatcccataaccaggcacaggggaactaacttggactaactaaccagaaaaccttgttaacgtataacttgttccagtactacatctctgcctgctggctcatgacaattgctcagcacattttcccctcttgaagaaaggttgcaagaagaactaaattatcctcaaaagatttctgcttcattagtaaagagtcagtgatggaatagggtgactctgcagaatagtggcctctagggtaggagcttgttgtgttgtccgtgggcctggaatgatcctggtggctgatcagggtccttctcccactctgggctgtatcaaccctgacggtcttggtctttggctcccctttatctggattctgagcacgctgactgtcctgttaatgccttccctccaaggaccagtatttggagattaattagattacaactctatctatgttacctttgtccttcctggtcaccttgcagattcaagacatgttcaaagcaacacattcacaacccatttctattctatagcaacctcgtctgtgactccttagcctggagaacaatctaccaagaagagaaagtatctggaattaagaagtcctaccatccaagccctacttcctggttgtgtggccttggaaaagtgactcaacctctttatattcagtttcctaaccatgaagtggaaatgataacacctgcctcattggggcactataacaagtgaaggacttaggaaaacatctggagtatagcgcctggcacccaggagatgcttaataaatgggaaccaggattctttttcttttcttttttcttttcttttttttttttttttgagacagagcctcaatctgtcacctgggctggagtgcagtggcacgctcacagctcgctgcagccttgaactcctgggctcaagggatgctccctcctcagcctccagagtagctgggactacaggtatgtgtcacctcaccaggctaatttttttattttttatttttgtagagatggggtctcgctgtgttgcccaggctggtcttgaacccctggcctcaagtgatccttctgctttggcctcccaaagtgctgggattacaggcatggactatggtgcccagcctaggagccaacattattattattataggcttttttttcaattgcaagatagacatttcttcacattttaatgattctgaaatcagaacatatcttgcaattgatgggttcattaatataattgtagttctttacttcctctcaaaaacttgtgatcttataattgatggcatcttggaaacaaggtaataaatctctattctgttaaagaaagtgacacactttgacatttaacctcaaattttaggagtctctccctcttggggtcagaaatcccttctgaggccaggtgtcgtggctcatgcctgtaatcccagcactttgggaggctgaggcaggcgggtcacttgaggtcaggagtttgagaccagcctggccaacatggcaaaaccctgtctctactaataatacaaaatttagctgggcatggtggcatgcacctgtaatcccactactagggaggctgtggcatgagaatcacttgaacctggaaggcagaggttgcagtgagccaagatcgtgccactgcactccagcctgggcaacagagtgaaactgcatctcaaaaaaagaaaaatccattatgaggggaaatcaagagtcagggaggtaagaggtcttacccagggtcacacagctcatgatatcccactgtaaaaatactctgtggaatagctctggagaaatactggcacattcttcctctctggtcattatttcttcctactgtgtttaaatatccaccaagtgtcaaggactttgtaagatgctttcacataaattatctcataggattaaattttcccaaaaacctggggaggaattattttttccaaaacagatgataatttctgattcaaagagaaagaaaacaaagtacttttccaaagtcacacagctagtaagtcacaaagacaagactcaaaaccaggtctcttgactccaaagtctgtcttttttgtgaagtcacactcctctgctggcccagctcaaagcagcacagattctttatgggctgaacaaggggagtacgggtttgtccatgtgtttgagtagagatcagggttctggcttccaggctgaaggtgagggaaaagccacttctaactcctttgggcatccatgctcacggccaaaagagccccttctcaacacatccaagtgctaaggattcctgcttcattcaagctactacttaggcccaaggagcaaggggtagaatggcatctaaccagagcaaagccatttctttgagggctcaagccataaacaaatatgctcccctaaacatattcggcttgaaaaagttgttttggggcagctgtggtggtgcacccctgtaatcccagccctttgggagtcagaggcagtcagtcacttgagcccaggagttcaagactagcctgggcaacacggcgaaacctcgtctctacaaaaaatacaaaaattaaccaagcgtggtagtgcacgcctgtattcccagctacttgggaggctgaggtaggaggatggcttgagcctgggaggcagaggttgcagtgagctgagatcgcgccactgcactccagccggggtgacagagccagaccctgtctcaaagcatatttcaaccctaaaactagactcttctgcccacagtgcagtcttctaagggttaccctctggtatatgttcttttgctaaatgaaggcttggagttggagggaagaaggggagatggagtggtgagggcgagtcaaataaaaggatttgagtgtctcgtttttgactaatgaagatgattcaataaacatcctgtaagaagggttcctatgtgcaagttgaggtgctactaagtacattaagacacaattgctgctctcaaggagttagcagctggtctcatgcagggatctcaccacgtggttatgtattttgtttctgatgaggtgcctttcttagcagatgctgccttatttggccactgaaacaatcaaagctaataaatgcttaaagaaaaatatctgacaataaaaaggtttaaatc

SEQ ID NO: 160010 - DNA, 2094 bp, Homo sapiens
  Payload ID: 11294
  Gene Symbol: NHEJ1
  Gene Name: nonhomologous end-joining factor 1
  Uniprot ID: Q9H9Q4
  ENST ID: ENST00000356853
  CDS Start-End: 135-1034
cctgtatcccaagaccctgcctcctcttgcggtggggggaaagcggcctcttactctaggcctttcggtttgcgcgagcgggcaggaaagcgtgcgtgcggctaagagagtgggcgctctcgcggccgctgacgatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaacagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagataggtgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaacaacaataa

SEQ ID NO: 160011 - DNA, 1954 bp, Homo sapiens
  Payload ID: 11294
  Gene Symbol: NHEJ1
  Gene Name: nonhomologous end-joining factor 1
  Uniprot ID: Q9H9Q4
  ENST ID: ENST00000409720
  CDS Start-End: 1-951
atggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacggccctctgcagagacctcagctgtcaaaggtcaagaggaagaagccaaggggtctcttcagttaatctgttgtggcctcagctgctgaggatggacttggagaacagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagataggtgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaacaacaataataaa

SEQ ID NO: 160012 - DNA, 753 bp, Homo sapiens
  Payload ID: 11294
  Gene Symbol: NHEJ1
  Gene Name: nonhomologous end-joining factor 1
  ENST ID: ENST00000426304
  CDS Start-End: 1-675
cgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggacagaagcatcaaggcgctggtgagccctccagaggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaacagcttccaagcttcaccttgaaagaagcttacatggca

SEQ ID NO: 160013 - DNA, 734 bp, Homo sapiens
  Payload ID: 11294
  Gene Symbol: NHEJ1
  Gene Name: nonhomologous end-joining factor 1
  ENST ID: ENST00000457600
  CDS Start-End: 47-734
agtccgctggctgctgcccggcgtggatggtagggctcgagtgaagatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagaaactgccagaggcatgcagcattggtgatggaaagccctttgtcatgaatctgcaggatctgtatatggcagtcaccacacaagaggtccaagtgggac

SEQ ID NO: 160014 - DNA, 547 bp, Homo sapiens
  Payload ID: 11294
  Gene Symbol: NHEJ1
  Gene Name: nonhomologous end-joining factor 1
  ENST ID: ENST00000450447
  CDS Start-End: 147-299
ataggccccgcccctgtatcccaagaccctgcctcctcttgcggtggggggaaagcggcctcttactctaggcctttcggtttgcgcgagcgggcaggaaagcgtgcgtgcggctaagagagtgggcgctctcgcggccgctgacgatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaat

SEQ ID NO: 160015 - DNA, 2113 bp, Homo sapiens
  Payload ID: 11294
  Gene Symbol: NHEJ1
  Gene Name: nonhomologous end-joining factor 1
  ENST ID: ENST00000418099
  CDS Start-End: 80-778
ctaggcctttcggtttgcgcgagcgggcaggaaagcgtgcgtgcggctaagagagtgggcgctctcgcggccgctgacgatggaagaactggagcaaggcctgttgatgcagccatgggcgtggctacagcttgcagagaactccctcttggccaaggtttttatcaccaagcagggctatgccttgttggtttcagatcttcaacaggtgtggcatgaacaggtggacactagtgtggtcagccagcgagccaaggagctgaacaagcggctcactgctcctcctgcagctttcctctgtcatttggataatctccttcgcccattgttgaaggacgctgctcaccctagcgaagctaccttctcctgtgattgtgtggcagatgcactgattctacgggtgcgaagtgagctctctggcctccccttctattggaatttccactgcatgctagctagtccttccctggtctcccaacatttgattcgtcctctgatgggcatgagtctggcattacagtgccaagtgagggagctagcaacgttacttcatatgaaagacctagagatccaagactaccaggagagtggggctacgctgattcgagatcgattgaagacagaaccatttgaagaaaattccttcttggaacaatttatgatagagttaaaagatatacccatcaaaactggagacccggcatattggcctagaactctacatgctgcatcggtctctttttatcatgaaactgccagaggcatgcagcattggtgatggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagctgctgaggatggacttggagaacagcttccaagcttcaccttgaaagaagcttacatggcagcaatatttctaaaatagtgatacagtcagaggcctcctgtaagggcgagagaactgaagttgatgttgacaggcccacagggaattggccttccctgttcaagtggaagccagtctctgagaatcccgtgctctcctctcttttggtggaggttctgtaggttcaggtttctaccatggactttaggtatatagggcaagtcagcaagaaagcaccacacactcaggaagccttgtctacctttccctagcgtctctagccagccagccccagatactcctcagagacccacttctctcttttgcatggaataaaaagcactcacagtccctgcttttgggattacttatgctgtggaactcataacccaattcacttccttcactgggtcccaccccattgttgtctctggatgaagtctagccatcagtctggtccttcagattcttcgtaaacttttctgcagttgccagagctaagtctccatttggaaactttgatctcaagaactctcttgatggtgggcacaagacagataggtgattgctgctttcctttgccaaacttggatgcatttttctctttgtttccaaagtataggcaacaggttaaactaccacgtggggtagtttatcaatcctcccgcctcatccttctgcataactgggactaaaggcacacaccaccacacctagctaatttttgtatttttttgtgtgtggagacaaggctttgccatgttgcccaggctggtcttgaactcctggactctagtgatctgcccacctcaacctcccaaagtgctgggattacaggcatgagctaccacgcctatccaatttctggtttatttactttcgatggttaaatgcctccttattcaaatatcctgtatatatactggcgtttctgtcctgatgtcaagtctcgagagaagatgatcaaacaataataaaataattataataagaac

SEQ ID NO: 160016 - DNA, 2713 bp, Homo sapiens
  Payload ID: 11295
  Gene Symbol: NONO
  Gene Name: non-POU domain containing, octamer-binding
  Uniprot ID: Q15233
  ENST ID: ENST00000276079
  CDS Start-End: 206-1621
aatcgagaacgccattttgtaccccttggcaggcaccgagctccgtcgtctcgtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 160017 - DNA, 2606 bp, Homo sapiens
  Payload ID: 11295
  Gene Symbol: NONO
  Gene Name: non-POU domain containing, octamer-binding
  Uniprot ID: Q15233
  ENST ID: ENST00000373841
  CDS Start-End: 99-1514
tcgtttccggcggtcgcgcgctcttttctcgggacgggagaggccgtgtagcgtcgccgttactccgaggagataccagtcggtagaggggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 160018 - DNA, 1921 bp, Homo sapiens
  Payload ID: 11295
  Gene Symbol: NONO
  Gene Name: non-POU domain containing, octamer-binding
  Uniprot ID: Q15233
  ENST ID: ENST00000373856
  CDS Start-End: 313-1728
aacgccattttgtaccccttggcaggcaccgagctccgtcgtctcgtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggta

SEQ ID NO: 160019 - DNA, 726 bp, Homo sapiens
  Payload ID: 11295
  Gene Symbol: NONO
  Gene Name: non-POU domain containing, octamer-binding
  ENST ID: ENST00000454976
  CDS Start-End: 105-726
gcatatccagagcccgccgctttcgtagtcagatttctagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagat

SEQ ID NO: 160020 - DNA, 703 bp, Homo sapiens
  Payload ID: 11295
  Gene Symbol: NONO
  Gene Name: non-POU domain containing, octamer-binding
  ENST ID: ENST00000418921
  CDS Start-End: 1-703
ctcccgacatcactgaggaagaaatgaggaaactatttgagaaatatggaaaggcaggcgaagtcttcattcataaggataaaggatttggctttatccgcttggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaac

SEQ ID NO: 160021 - DNA, 622 bp, Homo sapiens
  Payload ID: 11295
  Gene Symbol: NONO
  Gene Name: non-POU domain containing, octamer-binding
  ENST ID: ENST00000420903
  CDS Start-End: 250-622
ctcttttctcgggacgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggaaacccgaaccctagcggagattgccaaagtggagctggacaatatgccactccgtggaaagcagctgcgtgtgc

SEQ ID NO: 160022 - DNA, 855 bp, Homo sapiens
  Payload ID: 11295
  Gene Symbol: NONO
  Gene Name: non-POU domain containing, octamer-binding
  ENST ID: ENST00000413858
  CDS Start-End: 113-855
ccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaact

SEQ ID NO: 160023 - DNA, 491 bp, Homo sapiens
  Payload ID: 11295
  Gene Symbol: NONO
  Gene Name: non-POU domain containing, octamer-binding
  ENST ID: ENST00000450092
  CDS Start-End: 295-491
gtgggatttcttggaacaatcagcgaaggaagaggctagggcgaagctaggtttggagggtggatggcgcttccgaggccccttgaggccttgtctctgccgccacactgccttctcagcccacccgcggggggccacctttctcaactcgcttcgcttcgggctttccccattttcgttcctgccctgtttctttgtgcaactcatctccgaatcttacccgtgtcaagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccagg

SEQ ID NO: 160024 - DNA, 2882 bp, Homo sapiens
  Payload ID: 11295
  Gene Symbol: NONO
  Gene Name: non-POU domain containing, octamer-binding
  Uniprot ID: Q15233
  ENST ID: ENST00000535149
  CDS Start-End: 644-1792
caggcgcagtgcaggactgctccgagcacgcctacgcgcgcattttctccccttcctctccctctttccactttcctctccctttttctcctctcctttccccctcccaccacttggtctttcagtctttcagtcagttcgtttaggtctctccttccgacccccacccccagctcctctccctttccttttccccctccccctttcctttcccgtctcacgcgccaggccgcttgcacatgcgcattaggtacaaagcctcgctctttgtccccatctgtcgttcacacgaactcaagcctttggcattcggcagccaatagaatctaagaaatggcggaaaaatgattccgcctcgggagctaaaccttgattggcagtttagctaaccaatcgagaacgccattttgtaccccttggcaggcaccgagctccgtcgtctcgtttccggcggtcgcgcgctcttttctcgggacgggagaggccgtgtagcgtcgccgttactccgaggagataccagtcggtagaggatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagcctttt

SEQ ID NO: 160025 - DNA, 5548 bp, Homo sapiens
  Payload ID: 11296
  Gene Symbol: NCAPD2
  Gene Name: non-SMC condensin I complex, subunit D2
  Uniprot ID: Q15021
  ENST ID: ENST00000315579
  CDS Start-End: 800-5005
aagttttggagcgccggacaagctgaggtccgcgactcgtcgctaagattccccaaaactgagatttcaagaaaattcaccctttccgctttctttggcgtccttcaaccgtgaaggaaatgaaggttgagaacctggaacccgcttccaatgaccaagccctttctctgtgcctcacaacagtcttccgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctgcaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgtctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttttaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 160026 - DNA, 2844 bp, Homo sapiens
  Payload ID: 11296
  Gene Symbol: NCAPD2
  Gene Name: non-SMC condensin I complex, subunit D2
  ENST ID: ENST00000382457
  CDS Start-End: 86-2844
gtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcag

SEQ ID NO: 160027 - DNA, 4290 bp, Homo sapiens
  Payload ID: 11296
  Gene Symbol: NCAPD2
  Gene Name: non-SMC condensin I complex, subunit D2
  ENST ID: ENST00000539084
  CDS Start-End: 80-325
tttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgtctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgt

SEQ ID NO: 160028 - DNA, 533 bp, Homo sapiens
  Payload ID: 11296
  Gene Symbol: NCAPD2
  Gene Name: non-SMC condensin I complex, subunit D2
  ENST ID: ENST00000539714
  CDS Start-End: 180-533
gagcgccggacaagctgaggtccgcgactcgtcgctaagattccccaaaactgagatttcaagaaaattcaccctttccgctttctttggcgtccttcaaccgtgaaggaaatgaagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctgcaattcctgataaaagtggtatcccgccactcccaggagcttccagctatcctggatgatacaactttgagtggatcagatagaaacgcccatctaaatgccctcaaa

SEQ ID NO: 160029 - DNA, 4661 bp, Homo sapiens
  Payload ID: 11297
  Gene Symbol: NCAPG
  Gene Name: non-SMC condensin I complex, subunit G
  Uniprot ID: Q9BPX3
  ENST ID: ENST00000251496
  CDS Start-End: 177-3224
cttacggcagtctcgcgggatttccccctctcgcgggaattatttgaacgttcgagcggtaaatactccctggggctgtcatagaagactactcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagatgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcacc

SEQ ID NO: 160030 - DNA, 3017 bp, Homo sapiens
  Payload ID: 11297
  Gene Symbol: NCAPG
  Gene Name: non-SMC condensin I complex, subunit G
  ENST ID: ENST00000514176
  CDS Start-End: 57-755
gctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcagatgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcc

SEQ ID NO: 160031 - DNA, 807 bp, Homo sapiens
  Payload ID: 11297
  Gene Symbol: NCAPG
  Gene Name: non-SMC condensin I complex, subunit G
  ENST ID: ENST00000510063
  CDS Start-End: 1-807
atatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaaggtacagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggta

SEQ ID NO: 160032 - DNA, 2763 bp, Homo sapiens
  Payload ID: 11298
  Gene Symbol: NCAPH
  Gene Name: non-SMC condensin I complex, subunit H
  Uniprot ID: Q15003
  ENST ID: ENST00000240423
  CDS Start-End: 44-2269
gacgcgcgcgatttaaaaccagctcaggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 160033 - DNA, 2363 bp, Homo sapiens
  Payload ID: 11298
  Gene Symbol: NCAPH
  Gene Name: non-SMC condensin I complex, subunit H
  Uniprot ID: Q15003
  ENST ID: ENST00000427946
  CDS Start-End: 190-2007
gatttaaaaccagctcaggagacgccaaggaaagatgggacctcccggcccaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgta

SEQ ID NO: 160034 - DNA, 673 bp, Homo sapiens
  Payload ID: 11298
  Gene Symbol: NCAPH
  Gene Name: non-SMC condensin I complex, subunit H
  ENST ID: ENST00000456906
  CDS Start-End: 24-673
agctcaggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaatattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgaggtgtg

SEQ ID NO: 160035 - DNA, 1852 bp, Homo sapiens
  Payload ID: 11298
  Gene Symbol: NCAPH
  Gene Name: non-SMC condensin I complex, subunit H
  ENST ID: ENST00000435975
  CDS Start-End: 30-1852
aaaaccagctcaggagacgccaaggaaagatgggacctcccggcccagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtc

SEQ ID NO: 160036 - DNA, 2952 bp, Homo sapiens
  Payload ID: 11298
  Gene Symbol: NCAPH
  Gene Name: non-SMC condensin I complex, subunit H
  ENST ID: ENST00000455200
  CDS Start-End: 296-2488
cgccaaggaaagatgggacctcccggcccagtacttaaattcacatagctgcagagtggatatttgtcccagattaacaaagaagcatcagaaacctatggcctcccccctgcacctccaagaaacccaaactctagaggttctagccattaagtattagagttggagaagatctcagtggacagtgtgtggtgaacctccacccctgtgacaggctcaagacttctttggatataggaaatgttctcttgaaggtttcttgagcaagaattttgttccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaat

SEQ ID NO: 160037 - DNA, 779 bp, Homo sapiens
  Payload ID: 11298
  Gene Symbol: NCAPH
  Gene Name: non-SMC condensin I complex, subunit H
  ENST ID: ENST00000435349
  CDS Start-End: 1-547
gttacttaagatggcccagggccatagggtagagactgagcattatgaagaaattgaagactatgattacaacaaccctaacgacacctccaacttttgccctggattacagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctagga

SEQ ID NO: 160038 - DNA, 727 bp, Homo sapiens
  Payload ID: 11299
  Gene Symbol: NCAPD3
  Gene Name: non-SMC condensin II complex, subunit D3
  ENST ID: ENST00000533155
  CDS Start-End: 16-243
cggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggaggcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggcatagaaaaaggggaaagccacccaggagagaagatattgagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtctttgtttcattaactaattttgagccagttcttcatgaatgtcatgttacacaagccagagctcttaaccaagcaaaatacataccagaactggcttattatggattgtatttgctgtgctctcccattcatggagaagg

SEQ ID NO: 160039 - DNA, 537 bp, Homo sapiens
  Payload ID: 11299
  Gene Symbol: NCAPD3
  Gene Name: non-SMC condensin II complex, subunit D3
  ENST ID: ENST00000534227
  CDS Start-End: 433-537
agttgacaagcgactgtgacaggcctcgccggaggagctgggccctgaatcaccctgctccccggccggctgtcggcgctgggggagggggtcccgggggtcgactcaccgatctgcccgatgaactcgatcttgatgccctggtgctccagccgcttgttggggttcttgagggcaaggctcaccttcccggagaccgtctccccgtcgtagaagaggaaatatttctccttcttcccgtcctccgtcttgtgctcggcccgcttcctactctctgcatcgttcagaaggatttccacctccacgctctgcccgaagccgaagaagctcatcgcaccgccgggccgggcgggtctcggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagact

SEQ ID NO: 160040 - DNA, 5025 bp, Homo sapiens
  Payload ID: 11299
  Gene Symbol: NCAPD3
  Gene Name: non-SMC condensin II complex, subunit D3
  ENST ID: ENST00000525964
  CDS Start-End: 291-2789
gcgggaaaaacgctgttagggtttaactcaggccctggctccttctcgaacgaattagcggaacacccgcaggagccttgtttggcttccacttttcggcccgcccagttctctgagcgtgcggcggacgacgccggtgattggttgagcgaatggaaacggctcggcgcggtggttggccagtgggaaattctgtacgttgtgattggtccacaggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggagagtatctggaccttcttcattgagaacaatgtttcccatagtacactggtggcattgttctatcattttgttcaaatagttcataagaagaatgtcagtgtacagtatcgagaatatggccttcatgccgctgggctttactttttgctactagaagtaccaggcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggcatagaaaaaggggaaagccacccaggagagaagatattgagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtctttgtttcattaactaattttgagccagttcttcatgaatgtcatgttacacaagccagagctcttaaccaagcaaaatacataccagaactggcttattatggattgtatttgctgtgctctcccattcatggagaaggagataaggtcatcagttgtgttttccatcaaatgctcagtgtaatattaatgttagaagttggtgaaggatcccatcgtgccccccttgctgttacctcccaagtcatcaactgtagaaaccaggcggtccagtttatcagcgcccttgtggatgaattaaaggagagtatattcccagtcgtccgtatcttactgcagcacatctgtgccaaggtggtagataaatcagagtatcgtacttttgcagcccagtccctagtccagctgctcagtaaacttccttgtggggaatacgctatgttcattgcctggctttacaaatactcccgaagttccaagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagcaggccctccagtctcttactgaactccttatggctcagcctagatgcgtgcagatccagaaagcctggttgcggggggtggtcccggtggtgatggactgcgagagcactgtgcaggagaaggccctggagttcctggaccagctgctgctgcagaacatccggcatcacagtcattttcactctggggacgacagccaggtcctcgcctgggcgcttcttactctcctcaccaccgaaagccaggaactgagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcagtcagcagaatcccaattcaaacaccttaggacatattctctgtgtgattgggcatattgcaaagcatcttcctaagagcacccgggacaaagtgactgatgctgtcaagtgtaagctgaatggatttcagtggtctctagaggtgatcagttcagctgttgacgccttgcagaggctttgtagagcatctgcagagacaccagcagaggagcagcactggttggaaaaagaatcatgtgtacagcgcgcagtcagggcctaggaagtcatctgccgcttgctgctggcccagggccattaggacggtggttacattgtcatgagagcctatgaggaaggcaagaactgtcttcaggaattgctgacgcaggtgtgtggggatgtactctccacctgcgagcaccgcctctccaacatcgttctcaaggagaatggaacagggaatatggacgaagacctgttggtgaagtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtcct

SEQ ID NO: 160041 - DNA, 773 bp, Homo sapiens
  Payload ID: 11299
  Gene Symbol: NCAPD3
  Gene Name: non-SMC condensin II complex, subunit D3
  ENST ID: ENST00000527944
  CDS Start-End: 190-773
ttgggtaagcccagtgtgtgtgggagaaaatgtgtgtgtttgcaaatgaaatgctgtgttgataatggcccagcaggcctctagtaagggagaccctggcactgcaggaagacccctgtcatcttgtccttctctggcatcagctgtgccccagacaaaacacccttgcagaccccctgacagcctcagatggccccccagttgtgggaattacacctcctctctgggccagagcatttctcagaagctcacgtttttctctctctctgtctctcagcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggt

SEQ ID NO: 160042 - DNA, 5061 bp, Homo sapiens
  Payload ID: 11299
  Gene Symbol: NCAPD3
  Gene Name: non-SMC condensin II complex, subunit D3
  Uniprot ID: P42695
  ENST ID: ENST00000534548
  CDS Start-End: 66-4562
ggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggagagtatctggaccttcttcattgagaacaatgtttcccatagtacactggtggcattgttctatcattttgttcaaatagttcataagaagaatgtcagtgtacagtatcgagaatatggccttcatgccgctgggctttactttttgctactagaagtaccaggcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggcatagaaaaaggggaaagccacccaggagagaagatattgagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtctttgtttcattaactaattttgagccagttcttcatgaatgtcatgttacacaagccagagctcttaaccaagcaaaatacataccagaactggcttattatggattgtatttgctgtgctctcccattcatggagaaggagataaggtcatcagttgtgttttccatcaaatgctcagtgtaatattaatgttagaagttggtgaaggatcccatcgtgccccccttgctgttacctcccaagtcatcaactgtagaaaccaggcggtccagtttatcagcgcccttgtggatgaattaaaggagagtatattcccagtcgtccgtatcttactgcagcacatctgtgccaaggtggtagataaatcagagtatcgtacttttgcagcccagtccctagtccagctgctcagtaaacttccttgtggggaatacgctatgttcattgcctggctttacaaatactcccgaagttccaagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagcaggccctccagtctcttactgaactccttatggctcagcctagatgcgtgcagatccagaaagcctggttgcggggggtggtcccggtggtgatggactgcgagagcactgtgcaggagaaggccctggagttcctggaccagctgctgctgcagaacatccggcatcacagtcattttcactctggggacgacagccaggtcctcgcctgggcgcttcttactctcctcaccaccgaaagccaggaactgagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcagtcagcagaatcccaattcaaacaccttaggacatattctctgtgtgattgggcatattgcaaagcatcttcctaagagcacccgggacaaagtgactgatgctgtcaagtgtaagctgaatggatttcagtggtctctagaggtgatcagttcagctgttgacgccttgcagaggctttgtagagcatctgcagagacaccagcagaggagcaggaattgctgacgcaggtgtgtggggatgtactctccacctgcgagcaccgcctctccaacatcgttctcaaggagaatggaacagggaatatggacgaagacctgttggtgaagtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaataca

SEQ ID NO: 160043 - DNA, 5539 bp, Homo sapiens
  Payload ID: 11299
  Gene Symbol: NCAPD3
  Gene Name: non-SMC condensin II complex, subunit D3
  ENST ID: ENST00000534532
  CDS Start-End: 607-3861
gctccagcggtcggcatggcagctgctacctcgctgggacaggctctgggcccacgcgtgccgcgcagtccctacagaactgcagttgtcttgtcttctcggagtgctttcggctacttttcccttattactttagctcgatacacgttgggctgcctttcacattcggatattacgctgttcgagtgctgacgggaaaggcagccctttgacacgcacgcgaaatgtcgcctgacgagggcaaaggtgacagttactaccggaagtaccctatctcagataccctttagattttcccccattgaagaaaaacgaggcgggaaaaacgctgttagggtttaactcaggccctggctccttctcgaacgaattagcggaacacccgcaggagccttgtttggcttccacttttcggcccgcccagttctctgagcgtgcggcggacgacgccggtgattggttgagcgaatggaaacggctcggcgcggtggttggccagtgggaaattctgtacgttgtgattggtccacaggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggagagtatctggaccttcttcattgagaacaatgtttcccatagtacactggtggcattgttctatcattttgttcaaatagttcataagaagaatgtcagtgtacagtatcgagaatatggccttcatgccgctgggctttactttttgctactagaagtaccaggcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggcatagaaaaaggggaaagccacccaggagagaagatattgagatggatgaaattatagaagaacaagaagatgagaatatttgtttttctgcccgggacctttctcaaattcgaaatgccatctttcaccttttaaagaattttttaaggcttctgccaaagttttccttgaaagaaaagccacaatgtgtacagaattgtatagaggtctttgtttcattaactaattttgagccagttcttcatgaatgtcatgttacacaagccagagctcttaaccaagcaaaatacataccagaactggcttattatggattgtatttgctgtgctctcccattcatggagaaggagataaggtcatcagttgtgttttccatcaaatgctcagtgtaatattaatgttagaagttggtgaaggatcccatcgtgccccccttgctgttacctcccaagtcatcaactgtagaaaccaggcggtccagtttatcagcgcccttgtggatgaattaaaggagagtatattcccagtcgtccgtatcttactgcagcacatctgtgccaaggtggtagataaatcagagtatcgtacttttgcagcccagtccctagtccagctgctcagtaaacttccttgtggggaatacgctatgttcattgcctggctttacaaatactcccgaagttccaagatcccacaccgggtttttactcttgatgttgtcttagctctgttagaactgcctgaaagagaggtggataacaccctctccttggagcatcagaagttcttaaagcataagttcctggtgcaggaaattatgtttgatcgttgcttagacaaggcgcctactgtccgcagcaaggcactgtccagctttgcacactgtctggagttgactgttaccagtgcgtcggagagtatcctggagctcctgattaacagtcctacgttttctgtaatagagagtcaccctggtaccttactgagaaattcatcagctttttcctaccaaaggcagacatctaaccgttccgaaccctcaggggagatcaacatagacagcagtggtgaaacagttggatctggagaaagatgtgtcatggcaatgctgagaaggaggatcagggatgagaagaccaacgttaggaagtctgcactgcaggtattagtgagtattttgaaacactgtgatgtctcaggcatgaaggaagacctgtggattctgcaggaccagtgtcgggaccctgcagtgtctgtccggaagcaggccctccagtctcttactgaactccttatggctcagcctagatgcgtgcagatccagaaagcctggttgcggggggtggtcccggtggtgatggactgcgagagcactgtgcaggagaaggccctggagttcctggaccagctgctgctgcagaacatccggcatcacagtcattttcactctggggacgacagccaggtcctcgcctgggcgcttcttactctcctcaccaccgaaagccaggaactgagccgatatttaaataaggcttttcatatctggtccaagaaagaaaaattctcacccacttttataaacaatgtaatatctcacactggcacggaacattcggcacctgcctggatgctgctctccaagattgctggctcctcacccaggctggactacagcagaataatacaatcttgggagaaaatcagcagtcagcagaatcccaattcaaacaccttaggacatattctctgtgtgattgggcatattgcaaagcatcttcctaagagcacccgggacaaagtgactgatgctgtcaagtgtaagctgaatggatttcagtggtctctagaggtgatcagttcagctgttgacgccttgcagaggctttgtagagcatctgcagagacaccagcagaggagcaggaattgctgacgcaggtgtgtggggatgtactctccacctgcgagcaccgcctctccaacatcgttctcaaggagaatggaacagggaatatggacgaagacctgttggtgaagtacatttttaccttaggggatatagcccagctgtgtccagccagggtggagaagcgcatcttccttctgattcagtccgtcctggcttcgtctgctgatgctgaccactcaccatcatctcaaggcagcagtgaggccccagcgtctcagccacccccccaggtcagaggttctgtcatgccctctgtgattagagcacatgccatcattaccttaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcagggaggtgatgcaggattaccgagatgagctcaaggacttctttgcagttgacaaacagctggcatcagagcttgagtatgacatgaagaagtaccaggaacagctggtccaggagcaggagctagcaaaacatgcagatgtggccgggacggctggaggtgctgaggtggcacctgtggcacaggttgccctgtgtttagaaacagtgccagttcctgctggccaagaaaaccctgccatgtcacctgccgtgagccagccctgcacacccagggcaagtgctggccatgtagcagtatcatctcctacacctgaaacagggccattgcagaggttgctgcccaaagccaggcccatgtccctgagcaccattgcaatcctgaattctgtcaagaaagccgtggagtcaaagagcaggcatcggagtcggagcttaggagtgctgcctttcactttaaattctggaagcccagaaaaaacgtgcagtcaggtgtcttcatacagtttggagcaagagtcgaatggcgagattgagcacgtgaccaagcgggccatcagcacccccgagaagagcatcagtgatgtcacgtttggagcaggggtcagttacatcgggacaccacggactccgtcgtcagccaaagagaaaattgaaggccggagtcaaggaaatgacatcttatgtttatcactgcctgataaaccgcccccacagcctcagcagtggaatgtgcggtctcccgccaggaataaagacactccagcctgcagcaggaggtccctccgaaagacccctctgaaaacagccaactaaacagcgcctcccaccagtgtccaggcaggcaggagcccttgaggaagcagtctcgtgtcctccgtgtgaaggcagctggatcacttcccgcagtccttgggcagcgctttgctgtggaacacgagagctcctcctcaggggcctggcactcaccttctattctgtatgatgtatttggttaaacactgtcaaataatagagatgtgccagatttagattttcttaccctaatctgtttaatattgtaactttattccatttgaaagtgtcaagcccattcagataagctataatctggtctttaaggaacacaactttaaaactgcagctttcttttatataaatcaagcctctgttaacttgaattccttatagtacatattttcccatctgtaatgacgaaattttgattctaatattttttctattatttataagtgcaaattttttaaaaaagtgtacagctttctaaaagtaataaaggtttagcataaatacagccttccagta

SEQ ID NO: 160044 - DNA, 1521 bp, Homo sapiens
  Payload ID: 11299
  Gene Symbol: NCAPD3
  Gene Name: non-SMC condensin II complex, subunit D3
  ENST ID: ENST00000530396
  CDS Start-End: 729-1521
tttgtttttttatttttcctttagtgtgagtgtatatttcatgctacctaagttattaatttttttgtaatattagttatttttcaaatacctaagaattgcaaaacatttcccaggcacaaaagaaacatacaaacaaaactcagcagccttttcaactatgaacaagaaagaaagaaagaaagaaagaaaggggacatgcattctttcctatttacccagctcagatttcaaattcagcatgggtatttagcatctgtagaggatatgtataatcaggagtaaaatgtttcacctctcaggctttgctgatcattttccaggtaaggggataactgcgaaattcaaatgttgactttaaaaggaagatgattttattagtgtaaaggaacatcccatagtatataactcctggggagtttatttctccttaggtatttttattcgactattcaagatgggtctgtctgcctttagttttttgttgtttgtgattgtgggcatgatgttttaactttgatgaaatagaagccattagcaagatgtatctggagaaaatttaggaatggaattaggatttagaatacagttgagacatcttcctgtcttctgtgccaggtaagctgtgcttacagcacgaggatctggcaaagaagagcatcccagccctggtgcgagagctcgaggtgtgtgaggacgtggctgtccgcaacaacgtcatcattgtaatgtgcgatctctgcattcgctacaccatcatggtggacaagtatattcccaacatctccatgtgtctgaaggattccgacccattcatccggaagcagacactcatcttgcttaccaatctcttgcaggaggaatttgtgaaatggaagggctccctgttcttccgatttgtcagcactctgatcgattcacacccagacattgccagcttcggggagttttgcctggctcacctgttactgaagaggaaccctgtcatgttcttccaacacttcattgaatgtatttttcactttaataactatgagaagcatgagaagtacaacaagttcccccagtcagagagagagaagcggctgttttcattgaagggaaagtcaaacaaagagagacgaatgaaaatctacaaatttcttctagagcacttcacagatgaacagcgattcaacatcacttccaaaatctgccttagtattttggcgtgctttgctgatggcatcctacccctggacctggacgccagtgagttactctcagacacgtttgaggtcctcagctcaaaggagatcaagcttttggcaatgagatctaaaccagacaaagacctccttatggaagaagatgacatggccttggcaaatgtagtcatgcaggaagctcagaagaagctcatctcacaagttcagaagaggaatttcatagaaaatattattccaattatcatctccctgaagactgtgctggagaaaaataagatcccagctttgcgggaactcatgcactatctcaggg

SEQ ID NO: 160045 - DNA, 1060 bp, Homo sapiens
  Payload ID: 11299
  Gene Symbol: NCAPD3
  Gene Name: non-SMC condensin II complex, subunit D3
  ENST ID: ENST00000526422
  CDS Start-End: 607-720
gctccagcggtcggcatggcagctgctacctcgctgggacaggctctgggcccacgcgtgccgcgcagtccctacagaactgcagttgtcttgtcttctcggagtgctttcggctacttttcccttattactttagctcgatacacgttgggctgcctttcacattcggatattacgctgttcgagtgctgacgggaaaggcagccctttgacacgcacgcgaaatgtcgcctgacgagggcaaaggtgacagttactaccggaagtaccctatctcagataccctttagattttcccccattgaagaaaaacgaggcgggaaaaacgctgttagggtttaactcaggccctggctccttctcgaacgaattagcggaacacccgcaggagccttgtttggcttccacttttcggcccgcccagttctctgagcgtgcggcggacgacgccggtgattggttgagcgaatggaaacggctcggcgcggtggttggccagtgggaaattctgtacgttgtgattggtccacaggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcggttccactggatgtctcacatgcagacatcatcaaacgtcacatgagtgaaaatgggattcccaaagcctgctaatggcaccatccaagccaccaacccaggagtcatggcatttctgcttcccctttcatgcccactaccactgtcctgcctctgaggtgtctcagggcagccccgctccattcctgatgctgctgccttcatcatagcctcgagcaattgcaggagtattttagctgctttctgatgttaactgtgccagcccatcccccacacttttgcagaacgacttttgaaaacacagctttgaatgtgtcaagcctgtacacctttaatgtttcccctttgtttcctaaataaatgaccacatccttggcatgctttataaga

SEQ ID NO: 160046 - DNA, 532 bp, Homo sapiens
  Payload ID: 11299
  Gene Symbol: NCAPD3
  Gene Name: non-SMC condensin II complex, subunit D3
  ENST ID: ENST00000532445
  CDS Start-End: 433-532
agttgacaagcgactgtgacaggcctcgccggaggagctgggccctgaatcaccctgctccccggccggctgtcggcgctgggggagggggtcccgggggtcgactcaccgatctgcccgatgaactcgatcttgatgccctggtgctccagccgcttgttggggttcttgagggcaaggctcaccttcccggagaccgtctccccgtcgtagaagaggaaatatttctccttcttcccgtcctccgtcttgtgctcggcccgcttcctactctctgcatcgttcagaaggatttccacctccacgctctgcccgaagccgaagaagctcatcgcaccgccgggccgggcgggtctcggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcggttccactggatgtctcacatgcagacatcatcaaa

SEQ ID NO: 160047 - DNA, 555 bp, Homo sapiens
  Payload ID: 11299
  Gene Symbol: NCAPD3
  Gene Name: non-SMC condensin II complex, subunit D3
  ENST ID: ENST00000525485
  CDS Start-End: 334-555
gagcgcggccggcgctccagcggtcggcatggcagctgctacctcgctgggacaggctctgggcccacgcgtgccgcgcagtccctacagaactgcagttgtcttgtcttctcggagtgctttcggctacttttcccttattactttagctcgatacacgttgggctgcctttcacattcggatattacgctgttcgagtgctgacgggaaaggcagccctttgacacgcacgcgaaatgtcgcctgacgagggcaaaggaacgactcggcgcgcgcgcgggagcgagctttgaaagttgagcacggcggcggcgagccggtgccctgggatcatggtggcgttgcggggccttggtagcggcctgcagccctggtgtccgctggatcttagactcgaatgggttgacacagtgtgggaactggatttcacagagactgagcctttggatcccagcatagaagcagagatcatagagactggattggctgcattcacaaaactctatgaaagccttttaccctttgctactggagaacatggatctatggaggta

SEQ ID NO: 160048 - DNA, 3930 bp, Homo sapiens
  Payload ID: 11300
  Gene Symbol: NCAPG2
  Gene Name: non-SMC condensin II complex, subunit G2
  Uniprot ID: Q86XI2
  ENST ID: ENST00000356309
  CDS Start-End: 146-3577
gagagcggcgcctgatgacgaccgggagggcggggcccgtctggggcgccggcgggtgcgtttgaatctggtccgagcgcgggaaacggcgggtccccgagcccagggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaaca

SEQ ID NO: 160049 - DNA, 3957 bp, Homo sapiens
  Payload ID: 11300
  Gene Symbol: NCAPG2
  Gene Name: non-SMC condensin II complex, subunit G2
  Uniprot ID: Q86XI2
  ENST ID: ENST00000409423
  CDS Start-End: 174-3605
gagggcggggcccgtctggggcgccggcgggtgcgtttgaatctggtccgagcgcgggaaacggcgggtccccgagcccagtaccagacctcctgtgcgaagagtaacctgctcttcggactgataactggatgggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaac

SEQ ID NO: 160050 - DNA, 5253 bp, Homo sapiens
  Payload ID: 11300
  Gene Symbol: NCAPG2
  Gene Name: non-SMC condensin II complex, subunit G2
  Uniprot ID: Q86XI2
  ENST ID: ENST00000409339
  CDS Start-End: 115-3585
ggggcccgtctggggcgccggcgggtgcgtttgaatctggtccgagcgcgggaaacggcgggtccccgagcccagggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatatgaggacttgctgtgttgcccaggctgggctctaactcctggactcctggactcaatctatccttctgcctcagtcccaattggctaggactgcaggcacacaccaccagacccagctaatgtaatttctatctatatgtgtctttatatttaaagtggtttttttatagacagtatataaatgggtcatgttttttgatcttctctgacaatctgtcttaaaattggtgcatatgtaccatattcaaagtgattattgatatagttggattaatatccaccatatttgttattgtcttctatttgttccccttgttatttgttcctatttctgtcttccactccttttctgtcttttgtggttttaactgaacattttatgatgccgttttctttcctagcatatcagttatacttttttttttttaaacctttcttagtggtttctttagagttggaatttttatttgtttttatctttcttagtggttgctttagagttggagttttcatttataactaatccacgtttgctttcagatgacactataccactttgcaggtagggtggtatataataacaaaataatcctaatccttgcctctcgttccttgtatcattgctgtcattcattttgctaaggtataagcagacataagcatacataattgaatatattgttgctattattattttgaacaaactacatcttaggtcatttaagaataagaaaaataaaagtttttatttaccttcacttactccttctttgatgcttctcctttgtttgtgttgatccaaattctgacctatattcttttccttccctccagagaacttcttttaatgcttctttcaaggcatgtctactggcaactaattctcttaattttggtttgtcagagagtcttttacttctactttatttctttgcagggataatgttatgtagtttataattctagttgatgaatttttttctctctgtactttatttaatttattattattattttttgagacagagtcttgctctgttgcctagggtggaacgcagtggtgtgatctcagttcactgcaacctctgcctcctaagttcaaacgattcttgtacctcagcctgctgagtagctggtatacaggcacatcgccgccacacccagctcatttttgtattagtggagacagggcttcaccatgttgcccaggctggtctcgaattcttgatctcaagtgatctactcgcctcagcttctcaaattgctgggattactccccgtgcccggccactctctgtactttaaacatttcgctatactctcttcttggctcgtgtagtatctgagaaataggatataattcttttttgctcctcagtagataaggtgtatttttccctatctggtttctttcaatactttttctttgtttgatttttctgtaggttgaatatgatatgcctaggtgtagttttcttttcttttttttttttttttttggcatttattctattcagtattctatgagcttcctggataaattctcagttattattgtctgaatatttcttctgttcctttctctcttctgaaattcttattatacatgttaacaccttttacagttgtctcacaggtcttggatatttcattctatcaaaacagctgcatttttgaattctgtttgctaatattttatttgagaatgtttgcattaggtttgaaataagattaaatggttgttggttgttttgtt

SEQ ID NO: 160051 - DNA, 2926 bp, Homo sapiens
  Payload ID: 11300
  Gene Symbol: NCAPG2
  Gene Name: non-SMC condensin II complex, subunit G2
  ENST ID: ENST00000441982
  CDS Start-End: 1-2696
atttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcgggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtat

SEQ ID NO: 160052 - DNA, 4134 bp, Homo sapiens
  Payload ID: 11300
  Gene Symbol: NCAPG2
  Gene Name: non-SMC condensin II complex, subunit G2
  ENST ID: ENST00000432615
  CDS Start-End: 196-1365
agtaccagacctcctgtgcgaagagtaacctgctcttcggactgataactggatggaatggcctttagaaagggagcatcttcagaatctgcagctgggatcagattgttcttttgttgaatcaactcagctctgccgagccagcatcttgctaagggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagaatgtatctctaaaagataagcacttaaaaccactctaccattattttataaaaaaagaataactcttcagtaaaacaaaacagaaaacagtaatagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagataactagcacatggataggagaagctttgtgaggctggatttactccctttttaaaaatggcctttgttgctaagctgtgtctgtctcttacagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 160053 - DNA, 1996 bp, Homo sapiens
  Payload ID: 11301
  Gene Symbol: NCAPH2
  Gene Name: non-SMC condensin II complex, subunit H2
  Uniprot ID: Q6IBW4
  ENST ID: ENST00000299821
  CDS Start-End: 79-1899
aactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgtgtctgctcctggctggcccggcctaataaagcagtgttgccatctca

SEQ ID NO: 160054 - DNA, 1388 bp, Homo sapiens
  Payload ID: 11301
  Gene Symbol: NCAPH2
  Gene Name: non-SMC condensin II complex, subunit H2
  Uniprot ID: Q6IBW4
  ENST ID: ENST00000395698
  CDS Start-End: 96-995
cagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcaggtgggacccacatggaggcctgcagaacctgagctgtgaactggcaaccctggctctggggccgagtcaccttgcacaaggaggacagtggtatggccttggccccagaccactggtctggggcagaagcccacctgtcttgcagcccgtcctgcaaccagcccttttgaagagcagcttctgtgttcctcccctctctgagcagaactgatgctcctcagagtagtgggctggcgtccaaggatttgagccctgtcgagctcacggcaacctgggatggccgccggttgccaaggcgcctctctgcagtcgggctggtaggagggagtgtctggaggccattgctgcctccctcaacccccggggtcaactgtacccagcctagagccaagaaatccttcctttttattcattaaaacaaaatcaacctga

SEQ ID NO: 160055 - DNA, 2077 bp, Homo sapiens
  Payload ID: 11301
  Gene Symbol: NCAPH2
  Gene Name: non-SMC condensin II complex, subunit H2
  ENST ID: ENST00000395701
  CDS Start-End: 95-1864
agcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggtgagtagcctgggatacgtgggagggggagacggtccccagaccctgctgatgtgccacccctgcaggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgtgtctgctcctggctggcccggcctaataaagcagtgttgccatctca

SEQ ID NO: 160056 - DNA, 2037 bp, Homo sapiens
  Payload ID: 11301
  Gene Symbol: NCAPH2
  Gene Name: non-SMC condensin II complex, subunit H2
  Uniprot ID: Q6IBW4
  ENST ID: ENST00000420993
  CDS Start-End: 123-1940
gcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttggagtctaagcccttcaagaaaggtaggccttactctgtgcccccctgtgtggaggaggctctgggacagaagcgcaagaggaagggcgctgccaagctgcaggacttccaccagtggtacctggctgcctatgcagaccatgccgacagcaggcggcttcggcgaaagggtccgtcctttgcagacatggaggtcctgtactggacacacgtgaaggagcagttggaaactctccggaagctgcagaggagggaggtggctgagcagtggctgcggcctgcagaggaggaccacctggaggattccctggaagacctgggggcagcagatgactttctagagcctgaggagtacatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgtgtctgctcctggctggcccggcctaataaagcagtgttgccatctca

SEQ ID NO: 160057 - DNA, 640 bp, Homo sapiens
  Payload ID: 11301
  Gene Symbol: NCAPH2
  Gene Name: non-SMC condensin II complex, subunit H2
  ENST ID: ENST00000418794
  CDS Start-End: 80-268
gaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagtgtcatttgctgagaaggaatacaggagatgagccagcgttggggaagatgttggctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacaggtaggg

SEQ ID NO: 160058 - DNA, 970 bp, Homo sapiens
  Payload ID: 11301
  Gene Symbol: NCAPH2
  Gene Name: non-SMC condensin II complex, subunit H2
  ENST ID: ENST00000523045
  CDS Start-End: 93-970
caaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaaggacaccgggaggactgaggagcagccaatggaagtttccgtgtgcaggagccctgtcccagcactcggcttctcccaggagccaggcccctctccagaaggcccgatgcccctgggtgggggcgaggacgaggatgcagaggaggcagtagagcttcctgaggcctcggcccccaaggccgctctggagcccaaggagtccaggagcccgcagcagagtgctgccctgcccaggaggtacatgctgcgggagcgggagggggccccagagcctgcatcctgcgtgaaggagactccagacccctggcagagcctggacccctttgactccttgga

SEQ ID NO: 160059 - DNA, 720 bp, Homo sapiens
  Payload ID: 11301
  Gene Symbol: NCAPH2
  Gene Name: non-SMC condensin II complex, subunit H2
  ENST ID: ENST00000518394
  CDS Start-End: 94-210
gcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctggctggatcagatctgcatttcttttgacgaaggcaagaccacaatgaacttcattgaggcagcgttgttgatccagggctctgcctgcgtctacagtaagaaggtggaatacctctactcactcgtctaccaggcccttgatttcatctctggaaagaggcgggccaagcagctctcttcggtgcaggaggacagggccaatggggttgccagctccggggtcccccaggaggcagagaatgagttcctgtcgctggatgacttccctgactcccggactaacgtggatctcaagaatgatcagacgcccagtgaggtcctcatcatccccctcctgcccatggccctggtggcccctgatgaaatggagaagaacaacaatcccctgtacagccgtcagggtgaggtcctggccagccggaaggatttcaggatgaacacgtgcgttccccaccccagaggggccttcatgttggagccagagggcatgtcccccatggaaccagcgggcgtttcccccatgccagggacccagaa

SEQ ID NO: 160060 - DNA, 521 bp, Homo sapiens
  Payload ID: 11301
  Gene Symbol: NCAPH2
  Gene Name: non-SMC condensin II complex, subunit H2
  ENST ID: ENST00000522304
  CDS Start-End: 1-425
acatggagcccgagggagcagaccccagggaagccgctgaccttgacgcagtgccgatgtccctgagctacgaggagctggttcgaaggaatgtggagctcttcatcgccacctcccagaagtttgtccaggagacagagctgagccagcgcatcagggactgggaggacacagtgcagcctctgctccaggagcagctcaatgagtggtgtccctttgcggagctggtggctggccagccggccttcgaggtgtgtcgttccatgctggcctccctgcagctggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgtgtctgctcctggctggcccggcctaataaagcagtgttgccatctc

SEQ ID NO: 160061 - DNA, 1978 bp, Homo sapiens
  Payload ID: 11302
  Gene Symbol: NCCRP1
  Gene Name: non-specific cytotoxic cell receptor protein 1 homolog (zebrafish)
  Uniprot ID: Q6ZVX7
  ENST ID: ENST00000339852
  CDS Start-End: 23-850
gacagtcgcgcagcctcgagggatggaggaggtgcgtgagggacacgcgctcggtggcgggatggaagccgatgggcccgcgagcctccaggagctgcctccctcgccacggtcgccttcaccgccgccgtcgccgccaccactgccctcgccgccgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaaggcatcaacatttatgagccagcaccccctactggtcccacccagcgacccctggaaactctgggcaatttccgtggctggtacattagaactgaaaagctccagcagaaccaaagctggacagtgaagcagcagtgtgtggaccttctggccgagggcctgtgggaggagctgctggatgacgaacaaccagccattacggtcatggactggttcgaggacagccggctggatgcgtgcgtctatgagctgcatgtctggctgctggcggccgaccgccgcacggtcattgctcagcaccacgtggccccccgaacttctgggagaggaccccctggccgctgggtccaggtgtcccacgtattccgccattatggtcccggtgtgcgctttatccacttcctgcacaaggccaagaaccgcatggagcctggtgggctgcggcggacacgggtgaccgactcctccgtgtctgtgcagctccgggagtgactggctggctcctctgtcctgaccccacagcacctccctgacctttaggagccccaactcttagtcacctcctaggcctcttatttctccctggcccttggcttctcacttgatggacagcttcacacacccttaagcggtggactccagcattttcccagcactgtctgagccccatgagggcggagccactccttgtaaattcagtgcccgacagatgctctggcacagatgctttgtagatctctgttgagagaatgcatagacacctgtgcccaaggatgctgagggctggtctctgcttctttgaacttcactgaaactgaatgctcactgctgtgttgccagcaccacccagcccagggctgtgaacggagtgggtggcagcaaatgtgtgttgaaaggggaatgaagccattcacttcactcagttcctgtcccatttaaccgccccgatccttgatcttccattaccttcacatcccggggtccttctgaactgaccttgacctctgatctcttcacacatctccccttagcatctccacttacctacttttttttttttttttgagatggcatctcactctgtcacccaggctggagtgtagtgacacgatctcgactcactgcaatttccacctctcaggttcaagtggttctcctgcctcagcctctcaagtagctgggattacaggtgcacagcacctcccccgactaatttttatatttttagtagagacgggatttcgccatgttggccaggctggtctcaaactcctgacctcaagtgatctgcccaccttggcttcccaaagtgctgggattgcagacgtgagtcactgcgcccagccattccatgtctcttaagtctcagaatctcccctagctccctccaggtgtctgcagtggttgtcccctcaaagctgtcccacaccctcctccgaggaccctttgtgtatctcctccagctaccgcagagcccacaaacccaggcatctatcaaagtccctcattcatgagggtggtgaggacacagactgcgaccagaacagaaatatgaaaatgtgaatgacagcgtcccccgtgtgtggaatgtggggattaaaagcatttatcaacctctaa

SEQ ID NO: 160062 - DNA, 554 bp, Homo sapiens
  Payload ID: 11303
  Gene Symbol: NOP10
  Gene Name: NOP10 ribonucleoprotein
  Uniprot ID: Q9NPE3
  ENST ID: ENST00000328848
  CDS Start-End: 105-299
ttccggttatgcaggaaggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactctta

SEQ ID NO: 160063 - DNA, 436 bp, Homo sapiens
  Payload ID: 11303
  Gene Symbol: NOP10
  Gene Name: NOP10 ribonucleoprotein
  ENST ID: ENST00000557912
  CDS Start-End: 51-161
ctgcagactgagcggtggaccgaattgggaccgctggcttataagcgatcatgtttctccagtattacctcaacgagcagggagatcgagtctatacgctgaagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaa

SEQ ID NO: 160064 - DNA, 2889 bp, Homo sapiens
  Payload ID: 11304
  Gene Symbol: NOP14
  Gene Name: NOP14 nucleolar protein
  Uniprot ID: P78316
  ENST ID: ENST00000314262
  CDS Start-End: 50-2623
cctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccaagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataa

SEQ ID NO: 160065 - DNA, 2535 bp, Homo sapiens
  Payload ID: 11304
  Gene Symbol: NOP14
  Gene Name: NOP14 nucleolar protein
  Uniprot ID: P78316
  ENST ID: ENST00000398071
  CDS Start-End: 15-2435
gcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccaagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgca

SEQ ID NO: 160066 - DNA, 3538 bp, Homo sapiens
  Payload ID: 11304
  Gene Symbol: NOP14
  Gene Name: NOP14 nucleolar protein
  Uniprot ID: P78316
  ENST ID: ENST00000416614
  CDS Start-End: 67-2640
tcttagggtagcgcgcgcctgtctctcttcgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccaagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggtcaaagtcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacgggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaa

SEQ ID NO: 160067 - DNA, 2723 bp, Homo sapiens
  Payload ID: 11304
  Gene Symbol: NOP14
  Gene Name: NOP14 nucleolar protein
  ENST ID: ENST00000502735
  CDS Start-End: 38-2404
cgggtctcgggcccttgggcgcagcggggcgcgcgccatggcgaaggcgaagaaggtcggggcgcgaaggaaggcctccggggcgccggcgggagcgcgagggggcccggcgaaggccaactccaatccgttcgaggtgaaagttaacaggcagaagttccagatcctgggccggaagacgcgccacgacgtgggactgcccggggtgtctcgcgcacgggccctcaggaagcgtacacagactttactaaaagagtacaaagaaagggataaatccaatgtattcagagataaacgcttcggagaatacaacagcaacatgagccccgaggagaagatgatgaagaggtttgctctggaacagcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctgctgagctgactgctgcccactttggaggaggcggtgggctccttcacaagaagactcaacaggaaggcgaggagcgggagaaaccgaagtcccggaaagagctgattgaagagctcattgccaagtcaaaacaagagaagagggagagacaagctcaacgagaagatgccctcgagctcacggagaagctagaccaagactggaaagaaattcagactctcctgtcccacaaaactcccaagtcagagaacagagacaaaaaggaaaaacccaagcccgatgcatatgacatgatggttcgcgagcttggctttgaaatgaaggcgcagccctctaacaggatgaagacggaggcagaattggcaaaggaagagcaggagcacctcaggaagctggaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagatggaaagatgaatgtcgaggaagatgtccaggaagagcaaagcaaggaagccagtgaccctgagagcaacgaggaagaaggtgacagttcaggcggggaggacacagaggagagcgacagcccagatagccacttggacctggaatccaacgtggagagtgaggaagaaaacgagaagccagcaaaagagcagaggcagactcctgggaaagggttgataagcggcaaggaaagagctggaaaagctaccagagacgagctgccctacacgttcgcagcccctgaatcctatgaggaactgagatctctgttgttaggaagatcgatggaagagcagcttttggtggtggagagaattcagaagtgcaaccacccgagtctcgcagaaggaaacaaagcaaaattagaaaaactgtttggctttcttttggaatacgttggcgatttggctacagatgacccaccagacctcacagtcattgataagttggttgtgcacttatatcatctttgccagatgtttcctgaatctgcaagtgacgctatcaaatttgttctccgagatgcgatgcatgagatggaagaaatgattgagaccaaaggccgggcggcattgccagggttggatgtgctcatttatttgaaaatcactgggctgctatttccaacttccgacttctggcacccagtggtgacccctgccctcgtgtgcctcagtcagctgctcaccaagtgccccatcctgtccctccaggacgtggtgaagggcctgttcgtgtgctgcctgttcctggagtatgtggctttgtcccagaggtttatacctgagcttattaattttcttcttgggattctttacatagcaactccaaacaaagcaagccaaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccgactgtcctgcctggctgtgggcctggccctgctgaagcgctgcgtgctcatgtacgggtccctgccatccttccacgccatcatggggcctctccaagccctcctcacggatcacctggcggactgcagccacccgcaggagctccaggagctgtgtcagagcacactgaccgaaatggaaagccagaagcagctctgccggccgctgacctgtgagaagagcaagcctgtcccactgaagcttttcacaccccggctggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattt

SEQ ID NO: 160068 - DNA, 551 bp, Homo sapiens
  Payload ID: 11305
  Gene Symbol: NOP16
  Gene Name: NOP16 nucleolar protein
  ENST ID: ENST00000502663
  CDS Start-End: 49-336
gagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaagatccttctggtctcaagggctctgttctctgcaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataagagtggcaagacttcctcgattctttgcagaagaggaagatggaggtggagtgactggtttacatcacagctgcccc

SEQ ID NO: 160069 - DNA, 1000 bp, Homo sapiens
  Payload ID: 11305
  Gene Symbol: NOP16
  Gene Name: NOP16 nucleolar protein
  ENST ID: ENST00000509257
  CDS Start-End: 30-482
tttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggtgagcggctcaggccccgtgggctggctgggaaggcgccctggaccattcgcggcttgatctgcttgcgcagcacctgtttcctgaaaccgagtgcaaagaaagggaggcaaaagagactctaggaaatggatcccattgacagggatctaacttgaatgaatgcttatggcaaggatagactgagtgaccttggttccagtctcactcacagataaatgttttgctcgcatggtgttttttggtttgtttttgttttcaagacagagtcttgctcagtcacccaggatggaagtctatttttggcttcctttaacagttgaaagatccggctacactggacccctgggcccaagtaggattagctggctatgatgggtcatgagctcctcagctggccccagctcctccctggcccgctggactctcaggccttcctggtcttttttttgagacagaatctcgctctgtcacccagggtggagttcagtggtgtgatcatggctcaccgcagcctcatcctcccgggctgaaacagtcctcctgcctcggcctcccaagtagctgggaccacagga

SEQ ID NO: 160070 - DNA, 472 bp, Homo sapiens
  Payload ID: 11305
  Gene Symbol: NOP16
  Gene Name: NOP16 nucleolar protein
  ENST ID: ENST00000616685
  CDS Start-End: 37-249
cagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagc

SEQ ID NO: 160071 - DNA, 954 bp, Homo sapiens
  Payload ID: 11305
  Gene Symbol: NOP16
  Gene Name: NOP16 nucleolar protein
  ENST ID: ENST00000621444
  CDS Start-End: 224-919
gtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatatttta

SEQ ID NO: 160072 - DNA, 1258 bp, Homo sapiens
  Payload ID: 11305
  Gene Symbol: NOP16
  Gene Name: NOP16 nucleolar protein
  Uniprot ID: Q9Y3C1
  ENST ID: ENST00000614830
  CDS Start-End: 437-973
acctatgggtaccaccgggttctcgcgggtcttgcgaacgaacttttccttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatatttta

SEQ ID NO: 160073 - DNA, 1087 bp, Homo sapiens
  Payload ID: 11305
  Gene Symbol: NOP16
  Gene Name: NOP16 nucleolar protein
  Uniprot ID: Q9Y3C1
  ENST ID: ENST00000618911
  CDS Start-End: 389-1087
cttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaa

SEQ ID NO: 160074 - DNA, 1206 bp, Homo sapiens
  Payload ID: 11305
  Gene Symbol: NOP16
  Gene Name: NOP16 nucleolar protein
  ENST ID: ENST00000613081
  CDS Start-End: 462-1172
cttgaaactctctggattcctgtaaacagtggggctcagcccctcaatgactggaggcttcgatggttcaaaggggacctccggaatcacagggccgggagtcgccatgtccgggccacagcagcaggagaaaatcgggactccgacctcagcctcccggtgaaggtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacaggcggtgccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataaggccatggccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatatttt

SEQ ID NO: 160075 - DNA, 963 bp, Homo sapiens
  Payload ID: 11305
  Gene Symbol: NOP16
  Gene Name: NOP16 nucleolar protein
  ENST ID: ENST00000619979
  CDS Start-End: 224-937
gtcatgaaaggggcggggaaacgaataaattgagccttgtacgcaggcgcaaatgctcgttgcatcctgggagtcgtagtgctcagcacggtagtgctacaaaaggactacatttccccaaatgcccgcaaagccttgtgcacgccttccggaaggagtttgttacacgaggtctgagagacagaggcagcgtgtttgagctgctggtgcggtggtcagcgcgatgcccaaggccaagggcaaaacccggaggcagaagtttggttacagtgtcaaccgaaagcgtctgaaccggaatgctcgacggaaggcagcgccgcggatcgaatgctcccacatccgacatgcctgggaccacgctaaatcggtacggcagaacctggccgagatggggttggctgtggaccccaacagggcggtgcccctccgtaagagaaaggtgaaggccatggaggtggacatagaggagaggcctaaagagcttgtacggaagccctatgtgctgaatgacctggaggcagaagccagccttccagaaaagaaaggaaatactctgtctcgggacctcattgactatgtacgctacatggtagagaaccacggggaggactataagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttctctg

SEQ ID NO: 160076 - DNA, 2683 bp, Homo sapiens
  Payload ID: 11306
  Gene Symbol: NOP2
  Gene Name: NOP2 nucleolar protein
  Uniprot ID: P46087
  ENST ID: ENST00000322166
  CDS Start-End: 123-2561
agcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 160077 - DNA, 2736 bp, Homo sapiens
  Payload ID: 11306
  Gene Symbol: NOP2
  Gene Name: NOP2 nucleolar protein
  Uniprot ID: P46087
  ENST ID: ENST00000382421
  CDS Start-End: 77-2614
gccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcggctggagtgcagtggctcggtcttggctcactgcaacctccacctcccgggttcaagcaattctcctgcctcagcttcccaagtagctgggatttacagttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 160078 - DNA, 2701 bp, Homo sapiens
  Payload ID: 11306
  Gene Symbol: NOP2
  Gene Name: NOP2 nucleolar protein
  Uniprot ID: P46087
  ENST ID: ENST00000399466
  CDS Start-End: 153-2579
gagtgccggccgaaagctaggtccggattgcacgtggagggccgcccgaagggcactctcggacattaacccgcattctggtgggtctagaggaaattgggggacgaagagtggcagcactgacctggtctgggacgtggggagaaggtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 160079 - DNA, 2751 bp, Homo sapiens
  Payload ID: 11306
  Gene Symbol: NOP2
  Gene Name: NOP2 nucleolar protein
  Uniprot ID: P46087
  ENST ID: ENST00000545200
  CDS Start-End: 81-1967
gccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacagacggtgtcttgctttgtcgctcaggctggactgcagtggtgcaatctcagctcattgcaacctccaccttccaggttcaagcgattcttgtgcctcagactcccaagtagctaggattacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 160080 - DNA, 1080 bp, Homo sapiens
  Payload ID: 11306
  Gene Symbol: NOP2
  Gene Name: NOP2 nucleolar protein
  ENST ID: ENST00000542944
  CDS Start-End: 256-1080
acatttccggagtgaaaggaacagccaaaggacattctgaggggtagaaagtacaggctcccagggtgtggggccagggaatgtgtggctgccattagtccaggactcttcaaacccttagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagacc

SEQ ID NO: 160081 - DNA, 657 bp, Homo sapiens
  Payload ID: 11306
  Gene Symbol: NOP2
  Gene Name: NOP2 nucleolar protein
  ENST ID: ENST00000545492
  CDS Start-End: 181-657
gtgcgcctgcgtggaacgattctgtggcgagtgccggccgaaagctaggtccggattgcacgtggagggccgcccgaagggcactctcggacattaacccgcattctggtgggtctagaggaaattgggggacgaagagtggcagcactgacctggtctgggacgtggggagaaggtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcggtg

SEQ ID NO: 160082 - DNA, 630 bp, Homo sapiens
  Payload ID: 11306
  Gene Symbol: NOP2
  Gene Name: NOP2 nucleolar protein
  ENST ID: ENST00000545915
  CDS Start-End: 124-369
tagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggtccgtgaaactaagagctggatgctacatgaggagtccctttgggtcctgggtagggaagaactcgctaaacatttccggagtgaaaggaacagccaaaggacattctgaggggtagaaagtacaggctcccagggtgtggggccagggaatgtgtggctgccattagtccaggactcttcaaacccttagggatctctgcaggagctgtccagacagctggtaagaagggaccccagtccctatttaatgctcctcgaggcaagaag

SEQ ID NO: 160083 - DNA, 689 bp, Homo sapiens
  Payload ID: 11306
  Gene Symbol: NOP2
  Gene Name: NOP2 nucleolar protein
  ENST ID: ENST00000536124
  CDS Start-End: 160-689
ctgtggcgagtgccggccgaaagctaggtccggattgcacgtggagggccgcccgaagggcactctcggacattaacccgcattctggtgggtctagaggaaattgggggacgaagagtggcagcactgacctggtctgggacgtggggagaaggtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgg

SEQ ID NO: 160084 - DNA, 848 bp, Homo sapiens
  Payload ID: 11306
  Gene Symbol: NOP2
  Gene Name: NOP2 nucleolar protein
  ENST ID: ENST00000542867
  CDS Start-End: 98-848
acgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttgggg

SEQ ID NO: 160085 - DNA, 3038 bp, Homo sapiens
  Payload ID: 11306
  Gene Symbol: NOP2
  Gene Name: NOP2 nucleolar protein
  Uniprot ID: P46087
  ENST ID: ENST00000541778
  CDS Start-End: 490-2916
aaagtgctgggattacaggcgtgagccactgcgcccagcctggaattccgtgatcttgacgctggactagggcagtggatgcgagggagagggctccaatgtcgggccctggttcgaggagaaggtgcggctttcacccaacagaaaccggccgtgaggctaaaagccaactccatgagggaaggtcggtcaagctcaatggtttcgtcacattgctccctccacccgccgcgggtgtaagctgcgcgtctccttcgaattgccccctactcgccgccgccggctccgctggcgttcccagggcgagcgtaagttccgggtgcggcggccgactaggcgcaacaggaagaggcggggccgcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctg

SEQ ID NO: 160086 - DNA, 572 bp, Homo sapiens
  Payload ID: 11306
  Gene Symbol: NOP2
  Gene Name: NOP2 nucleolar protein
  ENST ID: ENST00000538420
  CDS Start-End: 142-438
gaaagctaggtccggattgcacgtggagggccgcccgaagggcactctcggacattaacccgcattctggtgggtctagaggaaattgggggacgaagagtggcagcactgacctggtctgggacgtggggagaaggtaccatggggcgcaagttggaccctacgaaggagaagcgggggccaggccgaaaggcccggaagcagaagggtgccgagacagaactcgtcagattcttgcctgcagtaagtgacgaaaattccaagaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcc

SEQ ID NO: 160087 - DNA, 2613 bp, Homo sapiens
  Payload ID: 11306
  Gene Symbol: NOP2
  Gene Name: NOP2 nucleolar protein
  Uniprot ID: P46087
  ENST ID: ENST00000537442
  CDS Start-End: 45-2483
cacgcgcgacgccaccttctcccatttctgcctgccacagtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactga

SEQ ID NO: 160088 - DNA, 668 bp, Homo sapiens
  Payload ID: 11306
  Gene Symbol: NOP2
  Gene Name: NOP2 nucleolar protein
  ENST ID: ENST00000540228
  CDS Start-End: 164-409
gattctgtggcgagtgccggccgaaagctaggtccggattgcacgtggagggccgcccgaagggcactctcggacattaacccgcattctggtgggtctagaggaaattgggggacgaagagtggcagcactgacctggtctgggacgtggggagaaggtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggtccgtgaaactaagagctggatgctacatgaggagtccctttgggtcctgggtagggaagaactcgctaaacatttccggagtgaaaggaacagccaaaggacattctgaggggtagaaagtacaggctcccagggtgtggggccagggaatgtgtggctgccattagtccaggactcttcaaacccttagggatctctgcaggagctgtccagacagctggtaagaagggaccccagtccctatttaatgctcctcgaggcaaga

SEQ ID NO: 160089 - DNA, 2568 bp, Homo sapiens
  Payload ID: 11306
  Gene Symbol: NOP2
  Gene Name: NOP2 nucleolar protein
  ENST ID: ENST00000616948
  CDS Start-End: 1-2568
atggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaagggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactga

SEQ ID NO: 160090 - DNA, 2791 bp, Homo sapiens
  Payload ID: 11306
  Gene Symbol: NOP2
  Gene Name: NOP2 nucleolar protein
  Uniprot ID: P46087
  ENST ID: ENST00000620535
  CDS Start-End: 131-2668
gcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcggctggagtgcagtggctcggtcttggctcactgcaacctccacctcccgggttcaagcaattctcctgcctcagcttcccaagtagctgggatttacagttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgg

SEQ ID NO: 160091 - DNA, 2017 bp, Homo sapiens
  Payload ID: 11306
  Gene Symbol: NOP2
  Gene Name: NOP2 nucleolar protein
  Uniprot ID: P46087
  ENST ID: ENST00000617555
  CDS Start-End: 131-2017
gcgaggctagcgctacccgtgcgcctgcgtggaacgattctgtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacagacggtgtcttgctttgtcgctcaggctggactgcagtggtgcaatctcagctcattgcaacctccaccttccaggttcaagcgattcttgtgcctcagactcccaagtag

SEQ ID NO: 160092 - DNA, 3289 bp, Homo sapiens
  Payload ID: 11307
  Gene Symbol: NSUN3
  Gene Name: NOP2/Sun domain family, member 3
  Uniprot ID: Q9H649
  ENST ID: ENST00000314622
  CDS Start-End: 212-1234
tgcgcacgaaatctcccgcgggagctaagcctcttcgacaagaattctatagcgcgagcaaatcagtatctcgcgagaaattgaagaggaaacgtgagaatgaaagtggatgcccgcgaatcccggaagtcagactgtttttttcagttccctggaggctttttgatactgattcgcgtacacctgttgtttgaaagctctcagcgggacaatgctgacccagctgaaagcaaaatcagaggggaagcttgcaaaacagatttgcaaagttgtgttggatcattttgaaaaacagtattccaaagaactcggagatgcctggaatacagtaagggagatactaacatctccatcatgctggcaatatgctgtcctgcttaaccgattcaattatccttttgaactggaaaaggatttacatttgaagggctatcacacactctctcagggatctttacccaactatcctaaatcagtgaagtgttaccttagcagaactccgggccgaatcccttcagaaagacaccaaattggaaacctgaaaaaatattatctcctaaatgctgcttctcttctcccagtgttggctctggaattaagggatggggagaaggttctggatctctgtgctgctcctggagggaaatcaatagctctgctgcagtgtgcttgtccaggttatcttcattgtaatgaatatgatagtctgagattgaggtggctaaggcagacgttggaatctttcatcccacagcctttgataaatgtaattaaagtgtctgaattggatggcagaaaaatgggagatgcccagcctgaaatgtttgacaaggtgttagtggatgctccgtgttcaaatgatcgaagctggttgttttcttctgactctcagaaggcatcctgtaggataagtcaaaggaggaatttgcctcttctacagatagagctgttaaggtctgcaattaaggccttacgtcctggagggatacttgtatactctacatgcacgctttccaaggcagaaaatcaagatgtgatcagtgaaattttaaactcccacggtaacatcatgcctatggacattaaaggaatagcaaggacttgctcccacgacttcacatttgctcccactggccaggaatgtgggctcttagtgattccagataagggcaaagcctggggcccaatgtatgtagccaaattgaagaaatcatggagcacaggaaaatggtgacatgaatttgtaaactgtgtttatgtgttattatatttatatttctgaactcagtacatgttaatatttaaataattatgcagtaactttctctgggtctgtttggaatcctatttagttaatactttagcatcttagaatctaggcttgagaattgttcaggtgtatttttttcctagaaatatatctgtaacaatgatttaaggtggtgcagatggtgtttgttctatattataaatctgctgtctttgcttggcattttatagttaaattaattagaatatgtggttttatgcataacgtgtttagttctgtattctttctatgatagtgctttgaaccttcaaaaattcacattttccagcgctccgaccattttcccgcttatcaaatgtacaaatttgttcaaggtttttttttccccccaacttttgtaactgattgtctcagaactgattggtattctgagactaactttttaagcagcactatttctagttctggcaaaatagtttttttatttgcaatgttgttttctgttaaagactatattatgtttactgcaaaggtcagtgactctactgacaccagctttatttcccccactttttttgcattcacaaatacaaattgaaagggtaaattatattgaaaggcctttagaacagcagattcacatgcacatgtttgactttcgacattcagcttatagaattatggagtctatccagcaggctataaagcaagtacttgagacaaaaccggaatgattaataactgcaatcactgaactatatttggagagttttgttacataattgcagtcataatgagcactacagaatctgattatcttacattcacaatctggaggggctttttatttcactttgttataaaatgttctctgagaatatgatgccacatattaatgcacaagagggagatgcctaatgagagtggactgtgtgattaccagaacccagtgccatttactaagtggctctccatgtttacataaatcctgggaatactgtatacatttcttcttatgtacttagggttttagcttcagtcagcatcacactttttctccagaaattacttcacttagagtacaaacatatttttccaactattaagaaaaattatgcagcacatctcaaaaaatagcatctctttggaaaatagcctttaaaaaaaaacaactttatctgattatagaaatacaaaattctgctaaagctgaatacttttgaattgttcattatgttctgtgcctttaaactagagactatttgcttattaatattttttgttttgcaagcatatgtaacccggtttatatcatcaggaagtcttaggaagaatttttttttctgtaccttcagtctgttaatcatttgttttcctttatgtccaattgatatgtttaaagtaaagctaaagtccaggcacggtggcttatgcctgtaatcccagcactttgtcaggccgaggcagggggcatctcctgaggtcagaagttcgagactagcctgcccaacatggtaaaaccccgactctactaaaaatgcaaaaaaattagacaggcatggtggctggcaccagcaatcccagctacttaggaggctgaggcaggagaatcacttgaacccaggaggcagaggttgcagttagccaagatctcgccattgcactccagcctgggcgacaagagtgaaaccccgtagcaaaaaaataataataatagtaattaaataaaaataaagtaacgctagaactgttggaccaaatcaagtatatgggtaaatacagaagaataatgatggtggaaaagatgttttcttttttaagttatcattattagtttgttttttttatcttcagacactataggttttaaaaataggtttcttttatgtaggttaatcacagagtaaatctgcacactgtactttgttaaatgtcggtattttcccagtataatgcgatgaagcttaatctgaatacttggtatgctattgaatttactttcctatgattactgaaaaa

SEQ ID NO: 160093 - DNA, 582 bp, Homo sapiens
  Payload ID: 11307
  Gene Symbol: NSUN3
  Gene Name: NOP2/Sun domain family, member 3
  ENST ID: ENST00000483378
  CDS Start-End: 148-381
agtatctcgcgagaaattgaagaggaaacgtgagaatgaaagtggatgcccgcgaatcccggaagtcagactgtttttttcagttccctggaggctttttgatactgattcgcgtacacctgttgtttgaaagctctcagcgggacaatgctgacccagctgaaagcaaaatcagaggggaagcttgcaaaacagatttgcaaagttgtgttggatcattttgaaaaacagtattccaaagaactcggagatgcctggaatacagtaagtgttggctctggaattaagggatggggagaaggttctggatctctgtgctgctcctggagggaaatcaatagctctgctgcagtgtgcttgtccaggttatcttcattgtaatgaatatgatagtctgagattgaggtggctaaggcagacgttggaatctttcatcccacagcctttgataaatgtaattaaagtgtctgaattggatggcagaaaaatgggagatgcccagcctgaaatgtttgacaaggtgttagtggatgctccgtgttcaaatgatcgaagctggttgttttcttctgactctcagaa

SEQ ID NO: 160094 - DNA, 2150 bp, Homo sapiens
  Payload ID: 11308
  Gene Symbol: NSUN4
  Gene Name: NOP2/Sun domain family, member 4
  Uniprot ID: Q96CB9
  ENST ID: ENST00000474844
  CDS Start-End: 651-1805
ctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcactgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactcta

SEQ ID NO: 160095 - DNA, 2087 bp, Homo sapiens
  Payload ID: 11308
  Gene Symbol: NSUN4
  Gene Name: NOP2/Sun domain family, member 4
  Uniprot ID: Q96CB9
  ENST ID: ENST00000537428
  CDS Start-End: 734-1741
actgtctcttgttccccagctgtgtccacctacctttctgtcccccactcccccttttacttccctccctcccctccccctttcccttgcccattcttcccccacatgacttctcctttcctcattgattttccagcccggtcgccctcacccctcggaaaataccatagcgaccttgcctgcactcctgggtctccgccgccttgcaggaaaggattcagccccttcctcaacctcgagctgcctctggcgaccgggcaaggttacagcgaccaccctgtccatactgccggcccaaaccctggcaaaaggtgcaacgaatcctctcatcctctggactctccttgcttctccagagaccctttttcttgcctcactggaagccctggaatttcttctatgaccggcacgcccccctgcccaccccagccgattccctcgccacctccaccatctcttccacccccacaaccttcctcgcactcagggagatggtcttttgagtcctcttccccactcctggaaaggacctactgccgctagccctgccactcgggttccccactctccagcccttattttgagcagttcagcattccggggtcaccccctctctgtcagcggacaccttattgcagctggatgagtccctccagaatgcggcgtccctgtcttcaaggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctat

SEQ ID NO: 160096 - DNA, 4344 bp, Homo sapiens
  Payload ID: 11308
  Gene Symbol: NSUN4
  Gene Name: NOP2/Sun domain family, member 4
  ENST ID: ENST00000307089
  CDS Start-End: 39-494
gcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccaggcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctatagacctggggctgcagttggggacttcatgtcagtgcaaatgccattagttccatttgtaccagccagttactgagcccctgtcacccttgaagtgagttccacctgaccagtcttgagcagccaacaggctcaattaagcccgcctggtttttccatatggctcatgatctaatttaaggaacaagtaactaaaaatgttaagccagtgcaaaataatctgcttacctactcacattggaaaaaccctctgagctgaataattctggccattcctgctgtcaacaatactgctgcccaaatgtggcttaggaggctgcttctgccacaaaaccgtcatactcttgtgcgtgccttgttctttgttcattcatctagcaggtattcccagacctcgtgtatgacaggtagctagggagctcttggagatgtagcagttgggattgtgggagattactgggcttcctcatcctttagaatggtaactctccttttgctttctgaacacctaggaatttcctgatgttttgttttgttggattccagactttttgttgtttctagtctgcagctgagctctggtgcctgttctttggcccaccccctaatccctaactcttccctcagcatcacagggcttcactgcacacactgtgttcagggcaagatttcatcatttactgactgcatactcgatatgttgtttttgtaactttagccaaaagaaagtaacctttagtggcagggatataaaaaattgctcagggtcacttgcagatattttatttttaaactttttttttttttcctggaaaacatcctgtgcagaaaagggtatataattttagaatacctgaaggcttcttggcttttccactttccttattcctcctcttcctgccactctttttgtcccttctgtctttcctgctcatccttatttgggtattagaggtgtcagttgaggagggactttagctgaggttaagccttcttttgggatttgcattgtaattgagggccctggaagatctctgagactcaaaatcaggtgaagctaggaagatggagctttaaggagcatggctagtgctctgagtaggaccgtaaccgcctccgtgcgtggcatatggtccctgcatgctgttcactctgtatagtacttagtattcgctgaggctaagaggcctcaggtgcctgggcttctgcccttggactcctggatatccagcctagtgctaattgaatgctaagcagtggtaattcaaaatgagagggtcccctgcctctagagtcatcatctaattggggacaggcagacctagataagaaaagcagagaactactttggaaaacagtttatctgctgtaattgaacattcagctaccctataacccagttaatccaatactggggataaatcctagagaaactcatacatgtacaccaggagatgtgtacaagaatattcatagcaaccctattcacaaaagcaaaagcctagaaataacccagatgcccatgagcaagagagtggacaagtaaactggaatattcacataatagaacattatacaattgtcaaatgaactataatgatacctaaccatatggatgaatctgagcaataaaataattaagtgaaaaaagtttaatcccagaagagtaaatgtagcatgatgccctttctaaatgaaaggttttttcttttctatggagttattctttacatacaatatagttcataaattttaaatatattgtttaataaattttgataattgtatataatagtatagtcaccatcaagatgtagaaaatagaaaataggctaggcacagtggctcacgcctgtaatctcaacactttgggaggccaaggtgggaagatcacttgatcccaggaattctagatcagcttggacaatgtagtgagacctggtctttaccaaaaaaaaaaaaaaaaaaattagctgggtgcgctggcatgtgcctgtggtcccagctactcaggaggctgaggcaggaggatcacttgagcacaggagtttgaggctgcagtgagcagcctgggcaagagagtgagactccgttttgtgccactgcactccagccagggtgacagagtgagactctgtctcaaaaaaaaaaaaaaaaaaaaaggcattgggatttataatgtgctgtttaaagtctgaagctcggccaggtgcggtggctcacgcctgtaatcccaaaactttggaaggctgaggcaggtggatcacctgaggtcaggaggagttcaagaccagcctggccaacgtggtgaaaccccatctctataaaagtacaaaagggcatgatggcaggtgcctgtaatctcagctactcagtaggctggagcgggagaactgcttgaacctgggaggtggaggtttcagtgagccaagatagcgccattgcactccagcgtgggcgacagcaagagacttcatttcgataaataagtaaataaataaataaagtctgaagctccactggtcactccttttattgattatttgcagctggtctaaccagttacgtatgtctggcttgattacatggccagagcaacataaaagccctgctgggaacttctgatttgagctcttccaaaaccaggatggatgcctcacatagatcatgatgattcaatccaaaggcactttgcagtgcagtccacatgtgcataaggaccatggggagcttgtatttgggaattctgagattcctgatgtttacctacctagtctttctcttgctgccctgtatcctttgcctttaaataaaaatcttaagtgattatgctctgtgaagcctggataatcctttcaaatatttggtcttggaaaatttttgcatatatacatggaatcatacaatatgtagtctttggtgtttgacttctttgacttagtgtaatgtttttgagattca

SEQ ID NO: 160097 - DNA, 2126 bp, Homo sapiens
  Payload ID: 11308
  Gene Symbol: NSUN4
  Gene Name: NOP2/Sun domain family, member 4
  ENST ID: ENST00000495427
  CDS Start-End: 1-410
ctgtggcctctcaaggcccttgcaaagagcctctgcagatcccctacagctgccctttgccttcatccaaggattccagctgtagcaccaatcccagctgtagttcgactattattagcaaatgccagagtagtgacagcgagagcaggagttcccaccaaagccaaagccggagccaaagcaagagtccccatgatggcagaagtcagagctggagcaagaggcatcatctgagcagaagtccaagtcagaaaagcagtccctatcctagcagaagctggggccggagcagtaatcctcaacaaaacacaagtcagggccagagtgagagtccccaacttagcataaatgagcaccagggtgagagtccccaaattagcagaggtcagggcaagagcaagagtctatgatggcaaaagtcggaaccggagcaagagtccccaacatggcaaaggtcaaggccagagcaagagtccccaacatagcaggagccagagcaagagtcccagcgaggcaaaagtcacagagcaagagtcctcaccataacaagaaatgagggccagagcaaaagttctgaccagaccaaaaatctaggccagagcaaggcatagatagtaacaagattgccagctatagcaagcatcccagctgcagcaaccaggaccgacttgtgcactcctcatctgaagtcttcatttctcttttactctgcctccttgttcttgtcctcttgtcccctgctacccccatagcagtcatcctagaagtccctgttttggttcacacctcaagattctgtgggccctccttatccaacctttctggggtctgggaactctcccagcatgaccctcaaacctctgattctaagcatggtggtgctagtcactgtgtgacgctaggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactct

SEQ ID NO: 160098 - DNA, 3867 bp, Homo sapiens
  Payload ID: 11308
  Gene Symbol: NSUN4
  Gene Name: NOP2/Sun domain family, member 4
  ENST ID: ENST00000498008
  CDS Start-End: 9-1967
cctccagaatgcggcgtccctgtcttcaaggcacgtactgtgaccagcacactaatctctgttactctagcggatggccttcagcttttggaaccagcccggcaacctcctttccccttgctcatcagtccccgggaacgagcccagtgacctcccctcagctcactcatgtacccttggaaactggacccatgatttcgcctcctcctacacataggaccccgggaacttgcctcacgatttcacctcctcttgctcgccggccggtggaaactagtcctatggcctccccaaccctttctcacagagttttggaaactgggctgatgatctctctgccctctcactggttctcagggagaagttataatgacccccttctctccccagcatcttccccacctactggcagcttttaccatggcagccttaagcctctagactcttgtgaacccaaaccacagcttgacctgccccttgagaaaaattgttgtggcttcccactctcttctcaggcaggcatgcctggctctcccagctcacctcaggagggctcttatcattactcccatctttcctcagaggcctacatacctacccctgggagtccttgctatgccatctgcctgtgccccgggagtactgattctccttgctcaccccagtcccaggctcccaggaaggcttgcattgagtcccttctctcctgggaggcaactgggaactcttacctcatcctaaccccggacaccacaacttctggtcccccctgttcccaggaaccatctcgtccccatggtcctcattctgtcctttccttcccttcacccctgggcaaccagtttatatctccaccccagtcacttccccgcagaagctataatgaaccccctcttcccactccagtttccccccaaccgaagtcccctaagtccccagagttaagacagtcacatactccccacaaatgtctctccctagtcaacactccccagcacaccccttctggccagcccaagcccgctaaggcccacacctgtcccccacctccctcctgcctctctggtccttcttgtatgcagccatacatcacaactccttcaaattccagccccaaagaacttcccccagggactaccttactgactgtggtccctagagctctcaaaagtgttatccccacttcttttcccctctgccttccttgtgatcctgtctcggccaatagttatgctcagagcagccgccatggaccctccatagggcccccctgcaatacccatatatgctctgtggttccctccaccccccatccctgcccactgtctggctccctcaatcattcgacaggcccccctcccattgtgcccctgtgtgacacctatagcactcccaggggcccaccccaacctcgttgtcagcctgtgatgcctccttgttctacccacatctattcttttatccctttgagaacaccctttgatcctcaaagtttacccattgtcccccgagtccgggcctaccctgatactgtcccctgtggcctccatatctaccctgtggcctctcaaggcccttgcaaagagcctctgcagatcccctacagctgccctttgccttcatccaaggattccagctgtagcaccaatcccagctgtagttcgactattattagcaaatgccagagtagtgacagcgagagcaggagttcccaccaaagccaaagccggagccaaagcaagagtccccatgatggcagaagtcagagctggagcaagaggcatcatctgagcagaagtccaagtcagaaaagcagtccctatcctagcagaagctggggccggagcagtaatcctcaacaaaacacaagtcagggccagagtgagagtccccaacttagcataaatgagcaccagggtgagagtccccaaattagcagaggtcagggcaagagcaagagtctatgatggcaaaagtcggaaccggagcaagagtccccaacatggcaaaggtcaaggccagagcaagagtccccaacatagcaggagccagagcaagagtcccagcgaggcaaaagtcacagagcaagagtcctcaccataacaagaaatgagggccagagcaaaagttctgaccagaccaaaaatctaggccagagcaaggcatagatagtaacaagattgccagctatagcaagcatcccagctgcagcaaccaggaccgacttgtgcactcctcatctgaagtcttcatttctcttttactctgcctccttgttcttgtcctcttgtcccctgctacccccatagcagtcatcctagaagtccctgttttggttcacacctcaagattctgtgggccctccttatccaacctttctggggtctgggaactctcccagcatgaccctcaaacctctgattctaagcatggtggtgctagtcactgtgtgacgctaggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctat

SEQ ID NO: 160099 - DNA, 865 bp, Homo sapiens
  Payload ID: 11308
  Gene Symbol: NSUN4
  Gene Name: NOP2/Sun domain family, member 4
  ENST ID: ENST00000469918
  CDS Start-End: 8-328
cgccgatatggctgcgctgacactgaggggtgtccgggagctgctgaagcgtgtggacctcgcgacggtcccgcggagacatcgatataagaagaaatggcccggtcgccctcacccctcggaaaataccatagcgaccttgcctgcactcctgggtctccgccgccttgcaggaaaggattcagccccttcctcaacctcgagctgcctctggcgaccgggcaaggttacagcgaccaccctgtccatactgccggcccaaaccctggcaaaaggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatgg

SEQ ID NO: 160100 - DNA, 922 bp, Homo sapiens
  Payload ID: 11308
  Gene Symbol: NSUN4
  Gene Name: NOP2/Sun domain family, member 4
  ENST ID: ENST00000486270
  CDS Start-End: 26-190
gaattaccccgtggagcacgccgatatggctgcgctgacactgaggggtgtccgggagctgctgaagcgtgtggacctcgcgacggtcccgcggagacatcgatataagaagaaatggcctgtcctctctcttttaggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgc

SEQ ID NO: 160101 - DNA, 1672 bp, Homo sapiens
  Payload ID: 11309
  Gene Symbol: NSUN5
  Gene Name: NOP2/Sun domain family, member 5
  Uniprot ID: Q96P11
  ENST ID: ENST00000252594
  CDS Start-End: 17-1306
aaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactct

SEQ ID NO: 160102 - DNA, 1602 bp, Homo sapiens
  Payload ID: 11309
  Gene Symbol: NSUN5
  Gene Name: NOP2/Sun domain family, member 5
  Uniprot ID: Q96P11
  ENST ID: ENST00000310326
  CDS Start-End: 27-1439
acagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgt

SEQ ID NO: 160103 - DNA, 1663 bp, Homo sapiens
  Payload ID: 11309
  Gene Symbol: NSUN5
  Gene Name: NOP2/Sun domain family, member 5
  Uniprot ID: Q96P11
  ENST ID: ENST00000438747
  CDS Start-End: 78-1478
gctttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactct

SEQ ID NO: 160104 - DNA, 2269 bp, Homo sapiens
  Payload ID: 11309
  Gene Symbol: NSUN5
  Gene Name: NOP2/Sun domain family, member 5
  Uniprot ID: Q96P11
  ENST ID: ENST00000428206
  CDS Start-End: 15-1190
aggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctacgatagatcacagttttttattcttaatgtcacaagcaggagaaaaatctcacattcatactaaaagttccaactagactcaacaggaatgaagtctctatttgtaatggaaagtcccagcctcccgctgccgtccagtgcgtgtactgtacacatccacactcacactcactcagggttcccggaccggctgtcctgcctgcggaactgaggtaaactagctcaggtgctgacactaggagggtctaccttacataaggtacaggtagaagcttgattgctaggcccaggcccacccagaccctccaatcctaacaggtatttaggcttgaggttcactccctcctcagctgcacacgcagccaggtattaacgaggatcagagctgttctgaggggtgggaaggagcagccccaccaccactcactcaccctcagtcacatcggggagggggcaccagttacatttacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgttt

SEQ ID NO: 160105 - DNA, 471 bp, Homo sapiens
  Payload ID: 11309
  Gene Symbol: NSUN5
  Gene Name: NOP2/Sun domain family, member 5
  ENST ID: ENST00000455763
  CDS Start-End: 1-176
aacgtgaagcagctgtacgcgctggtgtgcgaaacgcagcgctactccgccgtgctggatgctgtgatcgccagcgccggcctcctccgtgcggagaagaagctgcggccgcacctggccaagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctga

SEQ ID NO: 160106 - DNA, 2201 bp, Homo sapiens
  Payload ID: 11310
  Gene Symbol: NSUN6
  Gene Name: NOP2/Sun domain family, member 6
  Uniprot ID: Q8TEA1
  ENST ID: ENST00000377304
  CDS Start-End: 420-1829
tccgccgagaaatagggggcgcgtgtttggaaattgatagaaaagataaagggaccgagctgctgtcagcctggcttactgatctgcgtccgtttcaccacggattcagttactaagcatttttttctttttttggttctttgcaacgtgagtggcattggctcagtgatttccatgagcatctctaccagaaaacattgcctcgatgaggtgtggtggaagcccggcagccccttctaatcggctaggcttgagaaagcgtgtacctctgcatttccgaaattaactcagcgtgatcggcaagattttcctcagcatctggtgtcaagacactcgtcactattaattcggaaagaaaaaaaaaaacaaaacaccgttttccagcatttctcttggtggagaactaaacaacaggaaaaatgtctattttccctaagatatctttgagacctgaggttgaaaactatcttaaggaaggctttatgaataaggagattgtgactgctttaggtaaacaagaagcagaaaggaagtttgaaactttgttaaagcacctgtcacatcctccatcatttacaactgtcagagtgaatacacatttagcctcagtacaacatgtgaaaaatctgttacttgatgaacttcagaagcagtttaatggattaagtgttcctattcttcaacatccagaccttcaagatgtgttacttattcctgttattggacccagaaagaatattaaaaaacaacagtgtgaagccattgttggagcccagtgtggcaatgcagttttaagaggagcccatgtctatgccccaggaattgtgtcagcatcacaatttatgaaagctggagatgttatttctgtatactctgatattaaaggaaaatgtaagaaaggagccaaagaatttgatggaacaaaagtatttcttggaaatgggatttctgaactaagccgcaaagaaatcttcagtggattacctgaactgaaaggcatgggcataagaatgacagaaccagtatatctcagcccttcatttgacagtgtactgccccgttacttatttttacaaaatttgccatctgccttagtaagtcatgtactaaatcctcaacctggagagaagattctagacttgtgtgcagcacctggagggaaaacaacacacattgcagcactaatgcatgatcagggagaagttatagcactggataaaatcttcaacaaagtagaaaaaatcaaacagaatgccttattgttagggctgaattccatcagggcattttgttttgatggaacaaaggcggttaaacttgatatggtggaggacacagaaggagaacctccatttctaccagaatcctttgaccgaattcttctggatgcaccctgtagtggaatgggacagagaccaaacatggcctgtacttggtctgtgaaggaagtggcatcatatcagccattacagcgaaaactcttcactgcagcggttcagctgctgaagccagagggtgtgctggtttatagcacgtgcactataacactggccgaaaatgaagaacaggttgcctgggccctgacaaaatttccttgccttcagcttcagccccaggaaccgcagattggaggagaaggaatgaggggagctgggctctcatgtgaacagttgaaacagctgcagcgatttgatccatcggctgtgccattaccggacactgacatggactctcttagagaggccagaagagaagacatgttgcgtctggctaataaggactctataggtttttttattgcaaaatttgtaaaatgcaaaagcacataggagagggatggatgctcagaaatgaaaattccaaacatttgctgtctgtggtttttttttttttaaccaaagtgttgtcaggccaactgaatgatgatgtggttgctatggaaacagaaaaggctgccagctgttttaccagggatccagagacatagaggaagtagggggtggtatgagattatattttctgtttttaaaagattttttttttttatgtatttagtagagtataaagaaaagcagatgcctatagatgtctggagcatattttcatttgtgatctaatgttttaatttgtaaagtgtacaagtcatttttaatgttaaaaattagtgaatctaacaaaaggaataaattagcaatatttga

SEQ ID NO: 160107 - DNA, 578 bp, Homo sapiens
  Payload ID: 11310
  Gene Symbol: NSUN6
  Gene Name: NOP2/Sun domain family, member 6
  ENST ID: ENST00000606425
  CDS Start-End: 132-578
ttgtttgttcctttcttaggtgggaaggatacgagcaagataaagcagcgagggatttaagtctggcaacagttggactgctggattttcagagaagtgttccccaaagcaaattatagtgctaatttccaatgttccataagcgtggcaagaaaaatgggaagttctcgattgtgactgctttaggtaaacaagaagcagaaaggaagtttgaaactttgttaaagcacctgtcacatcctccatcatttacaactgtcagagtgaatacacatttagcctcagtacaacatgtgaaaaatctgttacttgatgaacttcagaagcagtttaatggattaagtgttcctattcttcaacatccagaccttcaagatgtgttacttattcctgttattggacccagaaagaatattaaaaaacaacagtgtgaagccattgttggagcccagtgtggcaatgcagttttaagaggagcccatgtctatgccccaggaattgtgtcagcatcacaatttatgaaagctggagatgttatttctgtatactctgatattaaaggaaaatgtaagaaagga

SEQ ID NO: 160108 - DNA, 553 bp, Homo sapiens
  Payload ID: 11310
  Gene Symbol: NSUN6
  Gene Name: NOP2/Sun domain family, member 6
  ENST ID: ENST00000607346
  CDS Start-End: 167-274
gcacttacggcaacccacgccttcgacgtggcgttttcttcggtttcacttccggtgggaaggatacgagcaagataaagcagcgagggatttaagtctggcaacagttggactgctggattttcagagaagtgttccccaaagcaaattatagtgctaatttccaatgttccataagcgtggcaagaaaaatgggaagttctcggtaaggtatatagtattatttctagaaataaagatgaaccaatccaagattgattttttgtttgtttaatcctggcagtattcttaactaaattgtattcattcttccctttactttccagactttttaattttatttatttttttattttttgagacagagtcttgcccaggcagaggttgcagtgagctgagatagcaccactgcactccagcctgagcgacagaatgagactccatctcaaacaaacaaaaaagtctaaatgtcctcaattctgtccgtgtgtggcactagtgaagtaatttctggcaaatgctttatcagcattttctttccatagtttataga

SEQ ID NO: 160109 - DNA, 3546 bp, Homo sapiens
  Payload ID: 11311
  Gene Symbol: NSUN7
  Gene Name: NOP2/Sun domain family, member 7
  Uniprot ID: Q8NE18
  ENST ID: ENST00000316607
  CDS Start-End: 468-1895
gcggttgccatgaagacccggtccgggagcagtcgactgccggagactcgggaggctgagctttcctcggcctgagccagccagaccccgggcaccgcgctcacccctcttcgccgccacgtccgcgaaggcctcacgcgcgaggccaggcgaggccccgaggcgcccaccacttcacgacaccggagcgaaccgggcgccagaggctgcgacccccctgccccgaatcctgccggtgggagtggctgcatttgaaccaaacggccttcgcgggcagcagccgtcgccccgcagtcccggggctcccaagggcctgtgaccgacgccgccctccgcgtcttcgtccccgaagccccgggaaccatccgccctcgggagaccatgctgcagatgcgaggaaagccgtttcctggaacatcggaattctaaccccagggtgaaggactcacgacaggcgaggggcagacatgctgaattccacgggcgaactggagttttcgaacgaagaagatcccgagatcatctcccaactcacttccctgcctctgtccggtgggaaaagctcagctggtgtgcccgaaaaaacgggctatccggactccgtttatgtcatggcagccaacatttttcagggtattcgaatcgaaaagtcggcacagaaagtcttaatcaagtatgggaatgaacccctgcggtccttgtccgagtctgaggatcagtcctttcagcgtttgtcttatgagctggctttcagtgccctgaaatatcaagatattttggaaactatattgatagacagctgtatcttcccaagtaccacaataccagatcatttgagcagtcttattattgtgatgctatatgatttccaagatagaaaatttcaaactcgtgtcctttctgataatgaagagcccatatcagaagttcaagaagtagagaaccttcttaacagttttaagataaaattggctgcagcattggcaagatgtcgaatcaagcatgatgccctttcaatttaccacatccttccagaaacagttaggaaacaggaactaagggcctccactttaccactttatgcttggataaatacttgtaaaatcagccctgaagaagtttataataatttgaagagaagaggctataataaagtcaaatctgtattgcatattgatgataaagtctttgctgtggatcaacattgctatgatgtcttaatttttccatctcatcttaaaaatgatcttataaatatagatcttttcaaagattacaaacttatatttcaggacaaatctcgaagtcttgctgtccattctgtaaaggctttattaaatatggatgatgatgtcttaatggtcaatacaggctcatggtacacagtttcccacatgtcaattttaacaaataataatacctcaaaagtatttgtgtgtggagtacaatcacaagctaaggatcctgacttgaagacccttttcacaaaaataggatgtaaaaatattgaaatacttcatgagaaatttattaacattgaatcaaaggatcacaggttacagaaagttaaagtgattttgctgctacctcgttgttcaggactgggtgttagtaatccagtagaatttattttaaatgaacatgaagatacagaattccttaaagatcactctcaaggaggcatctcagtggacaaacttcacgttcttgctcaacagcagtatgaacagctaacacatgcaatgaaatttactaaagctcaagcagttgtttactgcacatgttcagtttttccagaagaaaatgaagctgttgttaagaaagcactggaatttcaagaccttgggaataaaggacaaccttacagcgggacccttctgagacagtgtctgtgaatgatgttttggcccgagctgcagccaagggtctgctggatgggattgagttgggtaaatcatcaaaacgggagaagaagaagaaaaaatcaaaaacatcattgacaaaaggtgccactactgataatggcatccaaatgaaaattgctgagttcctgaatcgagaaactaaagccagtgctaatctatcagagactgtaacaaaaccacctcttccccagaaaaatactgctcaagtgggggcttcctcacagaccagaaaacccaacaagctggccccccatcctgcagtgcctgcatttgtgaagaacacttgtccctccagaccgcgtgaacggcagacacacttcttaagacctcggccagaagacagaatggttgctctgaaacccatcaagattgttctgcctccagtctttatgccattttcaagtccccaagggatcagatctcggatgccaactcaacatttgtactgtcgttgggttgcacccaaggcacttgtgcccacctgccttcccacacactcactatccagaaaagaggaaaagcctaaagatgacacaccttcctccctactcaggcctcctcggcgatggctttgattgtcttgtgttttttataggggccaaagagcagttgattttttttcaaagtctagtatttctctgaagattctacatctctacacaagatattcattcttttggtcacctagggatcttctaagtgtgatattactttcagagaattcagacaagtgagaaacaataatgtaggagtcagcaaagcagaattcagagacttcagccaatcactgctgctctgagaggatccagttagagactcagtatcagcggtcagaacttatctcactcctgtgaactttcaggctggacttaaagctgccaagtttcccctgcagggaaggaaacactgcctcccttcagcaggtagctcattagaaagccaaacaggcaaacgatcctggcctctcccgccagctgaccgctcttcagcatccatgcggttgtagtcgtgactttctcagtcacgatcaagggtgattttttcttaaatatcaagctgttctttgaacagggaatgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcgatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaatgtattctcaattgcctaccaaaaattggtatgattatcatttctgggtctactgatttttcatcatggcaacagaaattgtcattaaatagaattaagatacaa

SEQ ID NO: 160110 - DNA, 3698 bp, Homo sapiens
  Payload ID: 11311
  Gene Symbol: NSUN7
  Gene Name: NOP2/Sun domain family, member 7
  Uniprot ID: Q8NE18
  ENST ID: ENST00000381782
  CDS Start-End: 496-2652
cgccgcgccccctgccccacctccgctcgcggttgccatgaagacccggtccgggagcagtcgactgccggagactcgggaggctgagctttcctcggcctgagccagccagaccccgggcaccgcgctcacccctcttcgccgccacgtccgcgaaggcctcacgcgcgaggccaggcgaggccccgaggcgcccaccacttcacgacaccggagcgaaccgggcgccagaggctgcgacccccctgccccgaatcctgccggtgggagtggctgcatttgaaccaaacggccttcgcgggcagcagccgtcgccccgcagtcccggggctcccaagggcctgtgaccgacgccgccctccgcgtcttcgtccccgaagccccgggaaccatccgccctcgggagaccatgctgcagatgcgaggaaagccgtttcctggaacatcggaattctaaccccagggtgaaggactcacgacaggcgaggggcagacatgctgaattccacgggcgaactggagttttcgaacgaagaagatcccgagatcatctcccaactcacttccctgcctctgtccggtgggaaaagctcagctggtgtgcccgaaaaaacgggctatccggactccgtttatgtcatggcagccaacatttttcagggtattcgaatcgaaaagtcggcacagaaagtcttaatcaagtatgggaatgaacccctgcggtccttgtccgagtctgaggatcagtcctttcagcgtttgtcttatgagctggctttcagtgccctgaaatatcaagatattttggaaactatattgatagacagctgtatcttcccaagtaccacaataccagatcatttgagcagtcttattattgtgatgctatatgatttccaagatagaaaatttcaaactcgtgtcctttctgataatgaagagcccatatcagaagttcaagaagtagagaaccttcttaacagttttaagataaaattggctgcagcattggcaagatgtcgaatcaagcatgatgccctttcaatttaccacatccttccagaaacagttaggaaacaggaactaagggcctccactttaccactttatgcttggataaatacttgtaaaatcagccctgaagaagtttataataatttgaagagaagaggctataataaagtcaaatctgtattgcatattgatgataaagtctttgctgtggatcaacattgctatgatgtcttaatttttccatctcatcttaaaaatgatcttataaatatagatcttttcaaagattacaaacttatatttcaggacaaatctcgaagtcttgctgtccattctgtaaaggctttattaaatatggatgatgatgtcttaatggtcaatacaggctcatggtacacagtttcccacatgtcaattttaacaaataataatacctcaaaagtatttgtgtgtggagtacaatcacaagctaaggatcctgacttgaagacccttttcacaaaaataggatgtaaaaatattgaaatacttcatgagaaatttattaacattgaatcaaaggatcacaggttacagaaagttaaagtgattttgctgctacctcgttgttcaggactgggtgttagtaatccagtagaatttattttaaatgaacatgaagatacagaattccttaaagatcactctcaaggaggcatctcagtggacaaacttcacgttcttgctcaacagcagtatgaacagctaacacatgcaatgaaatttactaaagctcaagcagttgtttactgcacatgttcagtttttccagaagaaaatgaagctgttgttaagaaagcactggaatttcaagaccttgggaataaaggacaaccttacaggcttagtcctcctgttcttccactgtgctccttaaaggaaattcaattgtctactgataaatttttcagaatggaaccatctgaaattaccaatggttgttttctttctattttaacaagggagcgggacccttctgagacagtgtctgtgaatgatgttttggcccgagctgcagccaagggtctgctggatgggattgagttgggtaaatcatcaaaacgggagaagaagaagaaaaaatcaaaaacatcattgacaaaaggtgccactactgataatggcatccaaatgaaaattgctgagttcctgaatcgagaaactaaagccagtgctaatctatcagagactgtaacaaaaccacctcttccccagaaaaatactgctcaagtgggggcttcctcacagaccagaaaacccaacaagctggccccccatcctgcagtgcctgcatttgtgaagaacacttgtccctccagaccgcgtgaacggcagacacacttcttaagacctcggccagaagacagaatggttgctctgaaacccatcaagattgttctgcctccagtctttatgccattttcaagtccccaagggatcagatctcggatgccaactcaacatttgtactgtcgttgggttgcacccaaggcacttgtgcccacctgccttcccacacactcactatccagaaaagaggaaaagcctaaagatgacacaccttcctccctactcaggcctcctcggcgatggctttgattgtcttgtgttttttataggggccaaagagcagttgattttttttcaaagtctagtatttctctgaagattctacatctctacacaagatattcattcttttggtcacctagggatcttctaagtgtgatattactttcagagaattcagacaagtgagaaacaataatgtaggagtcagcaaagcagaattcagagacttcagccaatcactgctgctctgagaggatccagttagagactcagtatcagcggtcagaacttatctcactcctgtgaactttcaggctggacttaaagctgccaagtttcccctgcagggaaggaaacactgcctcccttcagcaggtagctcattagaaagccaaacaggcaaacgatcctggcctctcccgccagctgaccgctcttcagcatccatgcggttgtagtcgtgactttctcagtcacgatcaagggtgattttttcttaaatatcaagctgttctttgaacagggaatgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcgatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaatgtattctcaattgcctaccaaaaattggtatgattatcatttctgggtctactgatttttcatcatggcaacagaaattgtcattaaatagaattaagatacaa

SEQ ID NO: 160111 - DNA, 3303 bp, Homo sapiens
  Payload ID: 11312
  Gene Symbol: NSUN2
  Gene Name: NOP2/Sun RNA methyltransferase family, member 2
  Uniprot ID: Q08J23
  ENST ID: ENST00000264670
  CDS Start-End: 313-2616
aggctgtccgcggagctccttgagcccgcgtgggaaacctgggcgcttcgcgcggagacgcctttgtggctgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaatata

SEQ ID NO: 160112 - DNA, 2619 bp, Homo sapiens
  Payload ID: 11312
  Gene Symbol: NSUN2
  Gene Name: NOP2/Sun RNA methyltransferase family, member 2
  Uniprot ID: Q08J23
  ENST ID: ENST00000506139
  CDS Start-End: 64-2262
agggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaaggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagatcttagatatgtgtgcagcacctggctcaaagaccacacagttaattgaaatgctacatgccgacatgaatgtcccctttccagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtctt

SEQ ID NO: 160113 - DNA, 3217 bp, Homo sapiens
  Payload ID: 11312
  Gene Symbol: NSUN2
  Gene Name: NOP2/Sun RNA methyltransferase family, member 2
  ENST ID: ENST00000504374
  CDS Start-End: 313-921
aggctgtccgcggagctccttgagcccgcgtgggaaacctgggcgcttcgcgcggagacgcctttgtggctgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcgggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaagccacgcaaaagagattctccattgcttaaagaacaaatattttaaggaattggaggacctggaggtggacggtcagaaagttgaagttccacagccactgagttggtatcctgaagaacttgcctggcacacaaatttaagtcgaaaaatcttgagaaaatcgccacacttggaaaagtttcatcagtttctagttagtgaaacagaatctggaaatattagtcgtcaagaagctgttagcatgatcccaccactgctcctcaacgtgcggcctcatcataagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcagtggagacggcactatgagaaaaaacattgatgtttggaaaaagtggaccaccttaaatagcttgcagctacatggcttacagctgcggattgcaacacgcggggctgaacagctggctgaaggtggaaggatggtgtattccacgtgttcactaaaccctattgaggatgaagcagtcatagcatctttactggaaaaaagtgaaggtgctttggagcttgctgatgtgtctaatgaactgccagggctgaagtggatgcctggaatcacacagtggaaggtaatgacgaaagatgggcagtggtttacagactgggacgctgttcctcacagcagacacacccagatccgacctaccatgttccctccgaaggacccagaaaagctgcaggccatgcacctggagcgatgccttaggatattaccccatcatcagaatactggagggttttttgtggcagtattggtgaaaaaatcttcaatgccgtggaataaacgtcagccaaagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagaaattttatgctttggatccttcattcccaaggatgaatttgttaactcggactacagaagggaagaaaaggcagctctacatggtttctaaggagttgcggaatgtgctgctgaataacagtgagaagatgaaggttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctcagatgactttgtgccttttggaataaagggtaaaataaactctcccagagtaagagctgtatcgtgaattgtcatactaattattgagggggacttatgtgcttttattgaatggagtgctttacaatttttatttttaaatggggttgggatccttggaatatttcaataaaattgataaaatat

SEQ ID NO: 160114 - DNA, 614 bp, Homo sapiens
  Payload ID: 11312
  Gene Symbol: NSUN2
  Gene Name: NOP2/Sun RNA methyltransferase family, member 2
  ENST ID: ENST00000514127
  CDS Start-End: 1-308
tagctcatgcaactgaggatttagagaataatggcagtaagaaagatggcgtgtgtggtcctcctccatcaaagaaaatgaagttatttggatttaaagaagatccatttgtatttattcctgaagatgacccattatttccacctattgagttattaacacggggatcaaagtctggtgtagaaataacagcggtgaagagtttgactgtgctttccggctggcacaggagggaatatatacattgtatccatttattaactcaagaattattactgtatcaatggaagatgttaagatactgttgacccaggaaaatcccttttttagaaaactcagcagtgagacctacagtcaagcaaaggacctggcaaagggaagcatcgtgctgaagtatgaaccagattctgcgaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactg

SEQ ID NO: 160115 - DNA, 2400 bp, Homo sapiens
  Payload ID: 11313
  Gene Symbol: NOP56
  Gene Name: NOP56 ribonucleoprotein
  Uniprot ID: O00567
  ENST ID: ENST00000329276
  CDS Start-End: 517-2301
ggctcgtccccgagtaggggacgggaacgcctgggtcccggggacgtggggcgcagggtctggggcccgaggccacggacgaagcgggaagccggctaggcagcggtctctgtctgggatggacgccgcgccccacgcggacctcccgccccgacttcacccagctctgctgcccgtaactcatatgacaagaacatcaggaaccggactattaccccgaaagggccttcccaagtcgtttcgccgcctgcagtgcccgaccgggggccgcgcgtccccggcaaccacgcccgcccgcgcagctgcagaggccggaaaaggcccgctcgcccgcgctcggcaccacccagcccgcgctccgggcgataccaccctgggcggcccctccaaaggccggagatggtgtcgtccccggcctccgattggtcgggggggcgggggcgtggcctctggagcctggttccgcgcgccggagcgcgctagccgcattgcgagccgaacccgggagctggcgccatggtgctgttgcacgtgctgtttgagcacgcggtcggctacgcgctgctggcgctgaaggaagtggaggagatcagtctgctgcagccgcaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 160116 - DNA, 856 bp, Homo sapiens
  Payload ID: 11313
  Gene Symbol: NOP56
  Gene Name: NOP56 ribonucleoprotein
  ENST ID: ENST00000445139
  CDS Start-End: 13-856
ggagctggcgccatggtgctgttgcacgtgctgtttgagcacgcggtcggctacgcgctgctggcgctgaaggaagtggaggagatcagtctgctgcagccgcaggtggaggagtctgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcaggcagagtaggtgtggagaaggcaaggctgtagctctatggtttttgatgaagcagctgggccagggagtgactgtggctctttgcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgg

SEQ ID NO: 160117 - DNA, 1628 bp, Homo sapiens
  Payload ID: 11313
  Gene Symbol: NOP56
  Gene Name: NOP56 ribonucleoprotein
  ENST ID: ENST00000415272
  CDS Start-End: 1-659
acttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacgacacgcgttcccctgccttggctacttaattgctgaagatgtaatgagcactgttctcacagcctgttcccctgtccttccctttaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctg

SEQ ID NO: 160118 - DNA, 1320 bp, Homo sapiens
  Payload ID: 11313
  Gene Symbol: NOP56
  Gene Name: NOP56 ribonucleoprotein
  ENST ID: ENST00000467196
  CDS Start-End: 1-757
gctggagaagctggaggagctgacaatggatggggccaaggctaaggctattctggatgcctcacggtcctccatgggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtaggtgcacgtctcatcgcacatgctggcagcctcaccaacctggccaagtatccagcatccacagtgcagatccttggggctgaaaaggccctgttcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctgaggtgcccacgagtgtattcggggagaagcttcgagaacaagttgaagagcgactgtccttctatgagactggagagataccacgaaagaatctggatgtcatgaaggaagcaatggttcaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggaaggagataggtgctgaacttgctcaagagcccagagagctggttgtagctcacacccgttccctgggcatgtgtgttctgtcctcggctgcctcccaggagtcctcaacctggggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaaga

SEQ ID NO: 160119 - DNA, 2046 bp, Homo sapiens
  Payload ID: 11314
  Gene Symbol: NOP58
  Gene Name: NOP58 ribonucleoprotein
  Uniprot ID: Q9Y2X3
  ENST ID: ENST00000264279
  CDS Start-End: 227-1816
gttgctatcccagaatcctcagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctgttgttaatgaacttatgagaggaattcgttcacaaatggatggattaatccctggggtagaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcaggttctcttttaaatttggccaagcatgcagcttctaccgttcagattcttggagctgaaaaggcacttttcagagccctcaaatctagacgggatacccctaagtatggtctcatttatcatgcttcactcgtgggccagacaagtcccaaacacaaaggaaagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaagtgaagtgaagacttacgatccttctggtgactccacacttccaacctgttctaaaaaacgcaaaatagaacaggtagataaagaggatgaaattactgaaaagaaagccaaaaaagccaagattaaagttaaagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaagacaa

SEQ ID NO: 160120 - DNA, 714 bp, Homo sapiens
  Payload ID: 11314
  Gene Symbol: NOP58
  Gene Name: NOP58 ribonucleoprotein
  ENST ID: ENST00000433543
  CDS Start-End: 1-564
gaaccacgtgaaatggcagctatgtgtcttggattggctcacagcctgtctcgatatagattgaagtttagcgctgataaagtagacacaatgattgttcaggcaatttccttgttagatgacttggataaagaactaaacaactacattatgcgatgtagagaatggtatggctggcatttccctgaattaggaaaaattatttcagataatttaacatactgcaagtgtttacagaaagttggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtgattgaaatctctgaatatcgaacccagctctatgaatatctacaaaatcgaatgatggccattgcacccaatgttacagtcatggttggggaattagttggagcacggcttattgctcatgcagatttctcgaatgctggcagccaaaaccgttttggctatccgttatgatgcttttggtgaggattcaagttctgcaatgggagttgagaacagagccaaattagaggccaggttgagaactttggaagacagagggataagaaaaataagtggaacaggaaaagcattagcaaaaacagaaaaatatgaacacaaaag

SEQ ID NO: 160121 - DNA, 655 bp, Homo sapiens
  Payload ID: 11314
  Gene Symbol: NOP58
  Gene Name: NOP58 ribonucleoprotein
  ENST ID: ENST00000426814
  CDS Start-End: 207-413
agagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactccagagaaagcaaacaaaatagtaaagctaaaacattttgagaaatttcaggatacagcagaagcattagcagggctggttttccccatgtgtgaggagaggtgagaagtggttaagttgatctccctgtggaaaccagcaacataatgctgaagcacaattcagtaaaaggtgttctacaagggaccaagcattcacagctctgatggagggcaaaatcaataagcagctgaaaaaagttctgaagaaaatagtaaaagaagcccatgaaccgctggcagtagctgatgctaaactaggaggggtcataaaggaaaagctgaatctcagttgtatccatagtcctg

SEQ ID NO: 160122 - DNA, 6033 bp, Homo sapiens
  Payload ID: 11315
  Gene Symbol: NOP9
  Gene Name: NOP9 nucleolar protein
  Uniprot ID: Q86U38
  ENST ID: ENST00000267425
  CDS Start-End: 94-2004
aaactttgtctggataaggcgcacgcttggcgacgtcgaaggtccgtccgcagttaaggaagcttttgcagccggacaggtcgcgaagcacacatggggcagggtccgcgctctccacacaaggtggggcgccggttcccagctggtggcaaacgggggcgcggggccaaggggtcggggcgccccttaccaggccgtaagcggcaaccctggccgcctccggatgggcgctcggagccggctccagattcgcacccgcacctgagcccggaagctctgggatatttccgccgggcgctgtcagcattgaaagaggctcccgagactggggaagaacgagatctgatggtgcacaatataatgaaggaagtagagactcaggccctagctttgtccacgaacaggactggcagtgagatgctgcaggaactgttgggattcagtcccttgaaaccgctttgtcgcgtgtgggctgctctgcgctctaacttgcgcactgtggcctgtcaccgatgcggggtccatgtattacaaagtgctttgctacagctccctcgattgctggggagtgctgcagaggaggaggaggaggaggaggaggatggaaaggatggtcccacggagaccctggaggagctggtcctgggactagccgctgaggtgtgtgatgattttcttgtctactgtggagacacacatggcagcttcgtggtcagaactctgcttcaggtgttaggagggactattctggagtctgagagagccaggccccgtggttcccaatcatctgaagcacagaagaccccagctcaggaatgtaagccagctgattttgaagtccctgaaacctttttgaatcgccttcaggacctgagctcctcctttctgaaggacattgcagtgtttatcactgataagatctccagcttctgtcttcaagtggctttacaggttttacaccgcaaacttccccagttttgcgctcatctctgcaatgctgtgattggctacctgagtactcgcggttcctcagtagatggcagtcccctactgctatttctccgagatcagacgagttccagactcctggagcaggtcctgctggtgttggagcccccaagactccagagcctctttgaggagcacttgcaggggcagctgcagaccctggctgcacatcccattgccaacttccctttgcagcgcttactggatgcagtcactacccctgagctgctgtcccctgtgtttgaggagctgagccctgtcttggaagctgtattggcccagggccacccaggggtagtcattgccctggtgggggcctgtcgcagagttggggcctaccaagccaaggtcctacagctcttgttggaggcattccactgtgcagagccctcatcccggcaagtggcctgtgtgcctctctttgccactttgatggcttatgaggtgtactatggactgacggaggaggagggggcagtgcctgcagagcaccaggtggcaatggccgcagccagagccttgggggatgtgacagtccttgggtctctactgctccagcatctgctgcacttctccactcctggtcttgtacttcgaagtctgggtgccttgacgggaccacagcttctgtcccttgcccaaagtcccgctggctctcatgtgctcgatgccatcctgaccagcccctctgtgacgcgcaagctgcgccgccgtgtgctgcagaacctaaagggacaatatgtggctctggcctgtagtcgccatggcagccgtgtgctagatgccatctggagtggagcagccttgagggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggccagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttccggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattctgtccctcgaactctccctatctcctgctaacccctgctcccatagaaaagctcactcggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctagcagctcctggcgggtggcagctgtcaggcctttccggatggtccgcttgtgatcacagacacggaaaggtcgctggggtggtggagctgaggtccagaccctccgtccaaactccgagcttatattagatactgacctggtagttgagaagaaaagtcaagaaggggcgaggaggggcttggtgagtgtaaagggcatgatgagggtagagtggctagagggctagggagggagagatctaggtttatcgattagggatgagggagagaccatggagtgcaggtgggggcgggtggctcaggagcttgacaagcccactgtggagtggggagcaggagaggaaggggtactggttagtctcctaggggctgagtggagtattgttgccctgcctatatcccctaaaggtggagggtagagcggagggttagcagtcacctgagtaagtcactggggttcagagctgagaggtactccatggtggaccggagagttccttccctggaacttctgggctgggtggttctctcctgtgctggggctttagtggtgttttctgttacaaacctgggatctcagcccaggacaaggtgggaatgagtcaagcctggactctggcccccctgcctggccagtaagaagggcaaagtccaaggggagggatgagggaggggccagatggggtcctggaggaagaattgcctggcaaaagccattggagcttgtatgtgtgtctttggtgatgacatgtgttgtgagggtagatgggaaccatgtaaaaggatgaaatgtgacttctggtgtttttttatttctatggagggaatttctggggacggtttctggctctcaggctctgagaagctgcagtttatgagtggctctgtgtgtgctgccacctactggagaagccataagctgcagctttaggaaaagggaacccggggcagagtgtggggaagtgggatggcagcatggcagggctttggaaaatgagaggtgagactgtgtccaggaagggtgtaaggagaggatggatcctgatacatggattcaggatcattagggtcctgtctgggacactggccttcctgcttacctgctctttccttcctccttggtcggaggaggggctggctcactgctctggcttcattttccagagctgcctgctgcagtcacacttaggtcatcttctctcacttttctccttttgccgattagtggacgtgacagagatgtgaatggggcagggatgtcctttgatggcatcaagactttagcttctggtgcgctgtgtcccagctctgatttcagttgcagccgtgatggacagttgcatggaagctgagactctcactgacagtgaaaccctcaaatgaacacaatccctgctttcctgccaaggatccttgtagggtcccccagcttccccactttttttctgtgtcctgacaaagaaacacagagtaacttgattgccctgtgacctggccagttgcatttcccctgcaggcttgagcccaagccagagccttgaaaaggtattcaggttgttgcccaaaacactgaaaaaaactggccctggccctgaaccaaataccttgaaccctcgtaaactccataccctgacccccttgttttggatatacccaggtagaacaactctctctcactgtctgttgtgaggatacgctgtagcccactcattaagtacattctcctaataaatgctttggactgat

SEQ ID NO: 160123 - DNA, 1942 bp, Homo sapiens
  Payload ID: 11315
  Gene Symbol: NOP9
  Gene Name: NOP9 nucleolar protein
  Uniprot ID: Q86U38
  ENST ID: ENST00000396802
  CDS Start-End: 77-1684
ggcgcacgcttggcgacgtcgaaggtccgtccgcagttaaggaagcttttgcagccggacaggtcgcgaagcacacatggggcagggtccgcgctctccacacaaggtggggcgccggttcccagctggtggcaaacgggggcgcggggccaaggggtcggggcgccccttaccaggccgtaagcggcaaccctggccgcctccggatgggcgctcggagccggctccagattcgcacccgcacctgagcccggaagctctgggatatttccgccgggcgctgtcagcattgaaagaggctcccgagactggggaagaacgagatctgatggtgcacaatataatgaaggaagtagagactcaggccctagctttgtccacgaacaggactggcagtgagatgctgcaggaactgttgggattcagtcccttgaaaccgctttgtcgcgtgtgggctgctctgcgctctaacttgcgcactgtggcctgtcaccgatgcggggtccatgtattacaaagtgctttgctacagctccctcgattgctggggagtgctgcagaggaggaggaggaggaggaggaggatggaaaggatggtcccacggagaccctggaggagctggtcctgggactagccgctgaggtgtgtgatgattttcttgtctactgtggagacacacatggcagcttcgtggtcagaactctgcttcaggtgttaggagggactattctggagtctgagagagccaggccccgtggttcccaatcatctgaagcacagaagaccccagctcaggaatgtaagccagctgattttgaagtccctgaaacctttttgaatcgccttcaggacctgagctcctcctttctgaaggacattgcagtgtttatcactgataagatctccagcttctgtcttcaagtggctttacaggttttacaccgcaaacttccccagttttgcgctcatctctgcaatgctgtgattggctacctgagtactcgcggttcctcagtagatggcagtcccctactgctatttctccgagatcagacgagttccagactcctggagcaggtcctgctggtgttggagcccccaagactccagagcctctttgaggagcacttgcaggggcagctgcagaccctggctgcacatcccattgccaacttccctttgcagcgcttactggatgcagtcactacccctgagctgctgtcccctgtgtttgaggagctgagccctgtcttggaagctgtattggcccagggccacccaggggtagtcattgccctggtgggggcctgtcgcagagttggggcctaccaagccaaggtcctacagctcttgttggaggcattccactgtgcagagccctcatcccggcaagtggcctgtgtgcctctctttgccactttgatggcttatgaggtgtactatggactgacggaggaggagggggcagtgcctgcagagcaccaggtggcaatggccgcagccagagccttgggggatgtgacagtccttgggtctctactgctccagcatctgctgcacttctccactcctggtcttgtacttcgaagtctgggtgccttgacgggaccacagcttctgtcccttgcccaaaggcccggaaggaaattgctgctgagcttggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattgg

SEQ ID NO: 160124 - DNA, 455 bp, Homo sapiens
  Payload ID: 11315
  Gene Symbol: NOP9
  Gene Name: NOP9 nucleolar protein
  ENST ID: ENST00000557362
  CDS Start-End: 1-293
cagtcactacccctgagctgctgtcccctgtgtttgaggagctgagccctgtcttggaagctgtattggcccagggccacccaggggtagtcattgccctggtgggggcctgtcgcagagttggggcctaccaagccaaggtcctacagctcttgttggaggcattccactgtgcagagccctcatcccggcaagtggcctgtgtgcctctctttgccactttgatggcttatgaggtgtactatggactgacggaggaggagggggcagtgcctgcagagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttccggcactttgatacct

SEQ ID NO: 160125 - DNA, 1833 bp, Homo sapiens
  Payload ID: 11316
  Gene Symbol: NDP
  Gene Name: Norrie disease (pseudoglioma)
  Uniprot ID: Q00604
  ENST ID: ENST00000378062
  CDS Start-End: 409-810
cctctctctctctccctctctctctccctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaagctgtgcagcagatactgtgatgatggattgcaagtgcaaagagtaagacaaaactccagcacataaaggacaatgacaaccagaaagcttcagcccgatcctgccctttccttgaacgggactggatcctaggaggtgaagccatttccaattttttgtcctctgcctccctctgctgttcttctagagaagtttttccttacaacaatgagaaaacatgtactagctgcatccttttctatgctctccctgctggtgataatgggagatacagacagtaaaacggacagctcattcataatggactcggaccctcgacgctgcatgaggcaccactatgtggattctatcagtcacccattgtacaagtgtagctcaaagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccgggactctgcatattctagtaataaagactctacatgcttgttgacagagagagatactctgggaacttctttgcagttcccatctcctttctctggtacaatttcttttggttcattttcagattcaggcattttcccccttggctctcaatgctgtttgggtttccaacaattcagcattagtgggaaaaagtgggccctcatacacaagcgtgtcaggctgtcagtgtttggtgcacgctggggaagaatttactttggaaagtagaaaagcccagcttttcctgggacatcttctgttattgttgatgtttttttttaccttgtcattttggtctaaggttgccattgctgctaaaggttaccgatttcaaagtccagataccaagcatgtggatatgtttagctacgtttactcacagccagcgaactgacattaaaataactaacaaacagattcttttatgtgatgctggaactcttgacagctataattattattcagaaatgactttttgaaagtaaaagcagcataaagaatttgtcacaggaaggctgtctcagataaattatggtaaaattttgtaagggagcagacttttaaagacttgcacaaatacggatcctgcactgactctggaaaaggcatatatgtactagtggcatggagaatgcaccatactcatgcatgcaaattagacaaccaagtatgaatctatttgtgggtgtgctatagctttagccgtgtcacgggcatcattctctaatatccacttgtccatgtgaaacatgttgccaaaatggtggcctggcttgtcttctgaacgtttggttcaaatgtgttttggtcctggaggctcaaattttgagttattcccacgttttgaaataaaaagagtatattcaaaa

SEQ ID NO: 160126 - DNA, 9371 bp, Homo sapiens
  Payload ID: 11317
  Gene Symbol: NOTCH1
  Gene Name: notch 1
  Uniprot ID: P46531
  ENST ID: ENST00000277541
  CDS Start-End: 77-7744
gcgcgtgtgcgtcccagccccgccggccagcgcaggaggccgccgcccgggcgcagagggcagccggtggggaggcatgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgccgctgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatctgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgccacgggggcacctgccaggaccgcgacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacatcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgatgtcaatgagtgcgactcacagccctgcctgcatggcggcacctgtcaggacggctgcggctcctacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacgaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagacttggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtga

SEQ ID NO: 160127 - DNA, 11389 bp, Homo sapiens
  Payload ID: 11318
  Gene Symbol: NOTCH2
  Gene Name: notch 2
  Uniprot ID: Q04721
  ENST ID: ENST00000256646
  CDS Start-End: 221-7636
aaacttcgggcggcggctgaggcggcggccgaggagcggcggactcggggcgcggggagtcgaggcatttgcgcctgggcttcggagcgtagcgccagggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtgaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatcccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaa

SEQ ID NO: 160128 - DNA, 5046 bp, Homo sapiens
  Payload ID: 11318
  Gene Symbol: NOTCH2
  Gene Name: notch 2
  ENST ID: ENST00000602566
  CDS Start-End: 447-1154
agacatgtgggttctttcaaacatactggacttcctccttaggttttagttgtgttagttaatagttgaatgttgaaggagaggatgccaagggatattaaagaagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttggcacttttatgttgtgagagctgagattcaccattctccaccatcctgagaagagctttgatagaagggctactcctgagcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccagaaacagtgagaaataagaggaacagagctctgggaaagggacaggcaagtctggaatggaaaagaacacgatgagaattagacactggaaaatatgtatgtgtggttaataaagtgctttaaactgaattgacattaacagtaggtgatcaactttcctatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgcacacacaacccaaagatagaaacaaaaagaggagcagtgtcggggagcttggggcctggtgttccatggagagggagaaaggaacaagcctggccaattcattcaactccttataaaaatgatgaggaggctgaaaaccaagaattttgattgggaacagaatacaagcagctggagcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagagattaaaggtcataggttggtcctcagtataaaatcaactggtaatttattcatttcatttggtaaaaatgtattgactgcctgctatgttctaggcaccatgctatgtatttggaatacagctatacaaagcattgtcacataattgaaatgaaaactttatattatttaagtcacaagaacaagctatttaattatattacttttagtttctcttttaataaagaatagataatgctatcattctagatactaaataagtgttttcttaacataatattactattcactttatcttgtagaagaaataactaaaatacgtctgtcttcactcctgcatttgtttgcattttaagggttaaagacagaaatagaaatgtaaacaactttattttgaaaatatttcaatattgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtatgtgggaggggagattagcatgaggggtgggaatggggagatttgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtatatatatatggcattgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcgtatgtcccaggtggagttcagaaaatattcacttcatttccacaaagggaaatagtgcctagagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgtttattgtctgtcttttccaaattctactgcctcttaccctctccagaatgaaaactagtatctttgtttttgtttactgatgtaacccaaacacctacaaacagtgcccagtatatactaggcccgcaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcgtcttgtatgacacagaaagaaatgtttcttcacagagggaggagaaaaatatcttcaagagagaactaattgaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatatgatatccctatatcattaaagtaaagcctaagcaca

SEQ ID NO: 160129 - DNA, 2954 bp, Homo sapiens
  Payload ID: 11318
  Gene Symbol: NOTCH2
  Gene Name: notch 2
  ENST ID: ENST00000579475
  CDS Start-End: 277-2868
tcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttggcacttttatgttgtgagagctgagattcaccattctccaccatcctgagaagagctttgatagaagggctactcctgaggcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggtgggtcctggaggtaccagcagggaccagaggggatacttgaccttgctttgtcagtgcctgagtctcagtgcccaggtctgtggggctgtaatgctcctccgagggctcactcctcagttgtccttcctgcctttactgactggatcttgagctttgaggaaacattgtggcctcctaagatgcaagtggtggacagtcatttgcctacattgtactttagtatttgaaagaaatttttttttaattgtatgtggctggaaccaggcacatagatgatggttgtctatcatttgaatgtttccaggacattagc

SEQ ID NO: 160130 - DNA, 5041 bp, Homo sapiens
  Payload ID: 11318
  Gene Symbol: NOTCH2
  Gene Name: notch 2
  ENST ID: ENST00000612822
  CDS Start-End: 447-1157
agacatgtgggttctttcaaacatactggacttcctccttaggttttagttgtgttagttaatagttgaatgttgaaggagaggatgccaagggatattaaagaagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttggcacttttatgttgtgagagctgagattcaccattctccaccatcctgagaagagctttgatagaagggctactcctgagcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccagaaacagtgagaagaggaacagagctctgggaaagggacaggcaagtctggaatggaaaagaacacgatgagaattagacactggaaaatatgtatgtgtggttaataaagtgctttaaactgaattgacattaacagtaggtgatcaactttcctatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgcacacacaacccaaagatagaaacaaaaagaggagcagtgtcggggagcttggggcctggtgttccatggagagggagaaaggaacaagcctggccaattcattcaactccttataaaaatgatgaggaggctgaaaaccaagaattttgattgggaacagaatacaagcagctggagcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagagattaaaggtcataggttggtcctcagtataaaatcaactggtaatttattcatttcatttggtaaaaatgtattgactgcctgctatgttctaggcaccatgctatgtatttggaatacagctatacaaagcattgtcacataattgaaatgaaaactttatattatttaagtcacaagaacaagctatttaattatattacttttagtttctcttttaataaagaatagataatgctatcattctagatactaaataagtgttttcttaacataatattactattcactttatcttgtagaagaaataactaaaatacgtctgtcttcactcctgcatttgtttgcattttaagggttaaagacagaaatagaaatgtaaacaactttattttgaaaatatttcaatattgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtatgtgggaggggagattagcatgaggggtgggaatggggagatttgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtatatatatatggcattgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcgtatgtcccaggtggagttcagaaaatattcacttcatttccacaaagggaaatagtgcctagagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgtttattgtctgtcttttccaaattctactgcctcttaccctctccagaatgaaaactagtatctttgtttttgtttactgatgtaacccaaacacctacaaacagtgcccagtatatactaggcccgcaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcgtcttgtatgacacagaaagaaatgtttcttcacagagggaggagaaaaatatcttcaagagagaactaattgaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatatgatatccctatatcattaaagtaaagcctaagcac

SEQ ID NO: 160131 - DNA, 1874 bp, Homo sapiens
  Payload ID: 11319
  Gene Symbol: NOTCH2NL
  Gene Name: notch 2 N-terminal like
  Uniprot ID: Q7Z3S9
  ENST ID: ENST00000362074
  CDS Start-End: 363-1073
gctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggccgcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaa

SEQ ID NO: 160132 - DNA, 5042 bp, Homo sapiens
  Payload ID: 11319
  Gene Symbol: NOTCH2NL
  Gene Name: notch 2 N-terminal like
  Uniprot ID: Q7Z3S9
  ENST ID: ENST00000578207
  CDS Start-End: 445-1155
acatgtgggttctttcaaacatactggacttcctccttaggttttagttgtgttagtcaatagttgaatgttgaaggagaggatgccaagggatattaaagaagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttgacacttttatgttgtgagagctgagattcaccattctccaccatcctgagaagagctttgatagaagggctactcgtgagcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagattcgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgttcattgtctgtcttttccaaattctactgcctcttaccctctccagaatgaaaactagtatctttgtttttgtttactgatgtaacccaaacacctacaaacagtgcccagtatatactaggcccacaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcaca

SEQ ID NO: 160133 - DNA, 1954 bp, Homo sapiens
  Payload ID: 11319
  Gene Symbol: NOTCH2NL
  Gene Name: notch 2 N-terminal like
  Uniprot ID: Q7Z3S9
  ENST ID: ENST00000579793
  CDS Start-End: 363-1055
gctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggccgcggcggcggcggcggaggaggcgaccgagaagatacccgccctgcgccccgctctgctgtgggcgctgctggcgctctggctgtgctgcgcgacccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccagcaacatggccaatctttcctaagctgctcagcttacaagaaaaggaatcatactgctaagaattcaaacttcagcagtcatagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtacaatcttctccataagacatacattgtggttataaaaaggcaaaagtcttagtgagaatcattggtattccatagaagagtgaattaaacacagccaagggaagacccacgtctcatacttctcttgtatattccaaagttccagggaaattccaggtgatagaggttatttcccatactgttaaagcaaggtttcagacacttctgaattttggtcccagtactctagaagggcacacctctgtcctggaaaataatacaagaatgaatactcttcccgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtacgaattggtcaatgaataattactaaatatgtgaatatttactggattgtatggatcctatgaataattactgaataatt

SEQ ID NO: 160134 - DNA, 8666 bp, Homo sapiens
  Payload ID: 11320
  Gene Symbol: NOTCH3
  Gene Name: notch 3
  Uniprot ID: Q9UM47
  ENST ID: ENST00000263388
  CDS Start-End: 77-7042
gcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgcgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccagaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggcggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttatttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagatgggacatgttccatagccttgctggggaagggcccactgccaactccctctgccccagccccacccttggccatctccctttgggaactagggggctgctggtgggaaatgggagccagggcagatgtatgcattcctttgtgtccctgtaaatgtgggactacaagaagaggagctgcctgagtggtactttctcttcctggtaatcctctggcccagcctcatggcagaatagaggtatttttaggctatttttgtaatatggcttctggtcaaaatccctgtgtagctgaattcccaagccctgcattgtacagccccccactcccctcaccacctaataaaggaatagttaacactcagtgttgttggtctgtgtctaggtaaggtggggagtggtggcagtgggacttctatctcccccacccagggctaacttgagctcccatcttggggtaaatacatttgacttgccagtctacttatgcttcctcttttggcagatgactaccgattggattagtggttgtcacctgacttaagctgagccaatcagattcttttgctcgagaactttctttaatggagaggctaagaaagttgtcagttggtggagctcttaaggtcacaatcagatttagaaatatcagtggccaattcgaggtggtgggcaaagagacaagcaaacagggcagaagaatgaagctaatattcagggagaatcagaaatgagagctcaaatggctccttgagggctgggggggttatctcggctcccagtgcagttatcaattccagttaattgagtgttcattccattgagatcaacaggtatttattaattgctttctaagtatctgatcatggttctgcatgaatttcacttttacttcatgctcctatgggttttggagataaccttggacccatgtaataaatacttctttacttgtgcca

SEQ ID NO: 160135 - DNA, 559 bp, Homo sapiens
  Payload ID: 11320
  Gene Symbol: NOTCH3
  Gene Name: notch 3
  ENST ID: ENST00000597756
  CDS Start-End: 1-532
tcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggtgagccccagcccttggtccactgggtgtcagcagtggcacagtgccattgcaatccagcctgggcaacagagtgagactctctcaaaaaacaaaacaaaataaaaccccaaacattggattaaaatataa

SEQ ID NO: 160136 - DNA, 564 bp, Homo sapiens
  Payload ID: 11320
  Gene Symbol: NOTCH3
  Gene Name: notch 3
  ENST ID: ENST00000595514
  CDS Start-End: 1-353
gcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcacc

SEQ ID NO: 160137 - DNA, 3858 bp, Homo sapiens
  Payload ID: 11320
  Gene Symbol: NOTCH3
  Gene Name: notch 3
  ENST ID: ENST00000601011
  CDS Start-End: 1-3858
gggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgc

SEQ ID NO: 160138 - DNA, 6745 bp, Homo sapiens
  Payload ID: 11321
  Gene Symbol: NOTCH4
  Gene Name: notch 4
  Uniprot ID: Q99466
  ENST ID: ENST00000375023
  CDS Start-End: 140-6151
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggattccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 160139 - DNA, 6745 bp, Homo sapiens
  Payload ID: 11321
  Gene Symbol: NOTCH4
  Gene Name: notch 4
  ENST ID: ENST00000383264
  CDS Start-End: 140-6151
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcctgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactgtctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 160140 - DNA, 6742 bp, Homo sapiens
  Payload ID: 11321
  Gene Symbol: NOTCH4
  Gene Name: notch 4
  ENST ID: ENST00000454571
  CDS Start-End: 140-6148
agacgtgaggcttgcagcaggccgaggaggaagaagaggggcagtgggagcagaggaggtggctcctgccccagtgagagctctgagggtccctgcctgaagagggacagggactggggcttggagaaggggctgtggaatgcagcccccttcactgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggcgagagatgccaggcccagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacacagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 160141 - DNA, 3741 bp, Homo sapiens
  Payload ID: 11321
  Gene Symbol: NOTCH4
  Gene Name: notch 4
  Uniprot ID: Q99466
  ENST ID: ENST00000425600
  CDS Start-End: 1-3147
tgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 160142 - DNA, 6745 bp, Homo sapiens
  Payload ID: 11321
  Gene Symbol: NOTCH4
  Gene Name: notch 4
  Uniprot ID: Q99466
  ENST ID: ENST00000457094
  CDS Start-End: 140-6151
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggtgagagatgccaggccaagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 160143 - DNA, 6745 bp, Homo sapiens
  Payload ID: 11321
  Gene Symbol: NOTCH4
  Gene Name: notch 4
  Uniprot ID: Q99466
  ENST ID: ENST00000439349
  CDS Start-End: 140-6151
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggcgagagatgccaggcccagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctctctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtcatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 160144 - DNA, 6751 bp, Homo sapiens
  Payload ID: 11321
  Gene Symbol: NOTCH4
  Gene Name: notch 4
  ENST ID: ENST00000437843
  CDS Start-End: 140-6157
agacgtgaggcttgcagcaggccgaggaggaagaagaggggcagtgggagcagaggaggtggctcctgccccagtgagagctctgagggtccctgcctgaagagggacagggaccggggcttggagaaggggctgtggaatgcagcccccttcactgctgctgctgctgctgctgctgctgctgctgctgctatgtgtctcagtggtcagacccagagggctgctgtgtgggagtttcccagaaccctgtgccaatggaggcacctgcctgagcctgtctctgggacaagggacctgccagtgtgcccctggcttcctgggtgagacgtgccagtttcctgacccctgccagaacgcccagctctgccaaaatggaggcagctgccaagccctgcttcccgctcccctagggctccccagctctccctctccattgacacccagcttcttgtgcacttgcctccctggcttcactggcgagagatgccaggcccagcttgaagacccttgtcctccctccttctgttccaaaaggggccgctgccacatccaggcctcgggccgcccacagtgctcctgcatgcctggatggacaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtttcataggcccagactgtgaggtgaatccagacaactgtgtcagccaccagtgtcagaatgggggcacttgccaggatgggctggacacctacacctgcctctgcccagaaacctggacaggctgggactgctccgaagatgtggatgagtgtgaggcccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggactcctgtgccacttggaagacatgtgtctgagccagccgtgccatggggatgcccaatgcagcaccaaccccctcacaggctccacactctgcctgtgtcagcctggctattcggggcccacctgccaccaggacctggacgagtgtctgatggcccagcaaggcccaagtccctgtgaacatggcggttcctgcctcaacactcctggctccttcaactgcctctgtccacctggctacacaggctcccgttgtgaggctgatcacaatgagtgcctctcccagccctgccacccaggaagcacctgtctggacctacttgccaccttccactgcctctgcccgccaggcttagaagggcagctctgtgaggtggagaccaacgagtgtgcctcagctccctgcctgaaccacgcggattgccatgacctgctcaacggcttccagtgcatctgcctgcctggattctccggcacccgatgtgaggaggatatcgatgagtgcagaagctctccctgtgccaatggtgggcagtgccaggaccagcctggagccttccactgcaagtgtctcccaggctttgaagggccacgctgtcaaacagaggtggatgagtgcctgagtgacccatgtcccgttggagccagctgccttgatcttccaggagccttcttttgcctctgcccctctggtttcacaggccagctctgtgaggttcccctgtgtgctcccaacctgtgccagcccaagcagatatgtaaggaccagaaagacaaggccaactgcctctgtcctgatggaagccctggctgtgccccacctgaggacaactgcacctgccaccacgggcactgccagagatcctcatgtgtgtgtgacgtgggttggacggggccagagtgtgaggcagagctagggggctgcatctctgcaccctgtgcccatggggggacctgctacccccagccctctggctacaactgcacctgccctacaggctacacaggacccacctgtagtgaggagatgacagcttgtcactcagggccatgtctcaatggcggctcctgcaaccctagccctggaggctactactgcacctgccctccaagccacacagggccccagtgccaaaccagcactgactactgtgtgtctgccccgtgcttcaatgggggtacctgtgtgaacaggcctggcaccttctcctgcctctgtgccatgggcttccagggcccgcgctgtgagggaaagctccgccccagctgtgcagacagcccctgtaggaatagggcaacctgccaggacagccctcagggtccccgctgcctctgccccactggctacaccggaggcagctgccagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggcatagacgtctcttccctttgccacaatggaggcctctgtgtcgacagcggcccctcctatttctgccactgcccccctggattccaaggcagcctgtgccaggatcacgtgaacccatgtgagtccaggccttgccagaacggggccacctgcatggcccagcccagtgggtatctctgccagtgtgccccaggctacgatggacagaactgctcaaaggaactcgatgcttgtcagtcccaaccctgtcacaaccatggaacctgtactcccaaacctggaggcttccactgtgcctgccctccaggctttgtggggctacgctgtgagggagacgtggacgagtgtctggaccagccctgccaccccacaggcactgcagcctgccactctctggccaatgccttctactgccagtgtctgcctggacacacaggccagtggtgtgaggtggagatagacccctgccacagccaaccctgctttcatggagggacctgtgaggccacagcaggatcacccctgggtttcatctgccactgccccaagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcactccagcctatgaccagtactgccatgatcacttccacaacgggcactgtgagaaaggctgcaacactgcagagtgtggctgggatggaggtgactgcaggcctgaagatggggacccagagtgggggccctccctggccctgctggtggtactgagccccccagccctagaccagcagctgtttgccctggcccgggtgctgtccctgactctgagggtaggactctgggtaaggaaggatcgtgatggcagggacatggtgtacccctatcctggggcccgggctgaagaaaagctaggaggaactcgggaccccacctatcaggagagagcagcccctcaaacgcagcccctgggcaaggagaccgactccctcagtgctgggtttgtggtggtaatgggtgtggatttgtcccgctgtggccctgaccacccggcatcccgctgtccctgggaccctgggcttctactccgcttccttgctgcgatggctgcagtgggagccctggagcccctgctgcctggaccactgctggctgtccaccctcatgcagggaccgcaccccctgccaaccagcttccctggcctgtgctgtgctccccagtggccggggtgattctcctggccctaggggctcttctcgtcctccagctcatccggcgtcgacgccgagagcatggagctctctggctgccccctggtttcactcgacggcctcggactcagtcagctccccaccgacgccggcccccactaggcgaggacagcattggtctcaaggcactgaagccaaaggcagaagttgatgaggatggagttgtgatgtgctcaggccctgaggagggagaggaggtgggccaggctgaagaaacaggcccaccctccacgtgccagctctggtctctgagtggtggctgtggggcgctccctcaggcagccatgctaactcctccccaggaatctgagatggaagcccctgacctggacacccgtggacctgatggggtgacacccctgatgtcagcagtttgctgtggggaagtacagtccgggaccttccaaggggcatggttgggatgtcctgagccctgggaacctctgctggatggaggggcctgtccccaggctcacaccgtgggcactggggagacccccctgcacctggctgcccgattctcccggccaaccgctgcccgccgcctccttgaggctggagccaaccccaaccagccagaccgggcagggcgcacaccccttcatgctgctgtggctgctgatgctcgggaggtctgccagcttctgctccgtagcagacaaactgcagtggacgctcgcacagaggacgggaccacacccttgatgctggctgccaggctggcggtggaagacctggttgaagaactgattgcagcccaagcagacgtgggggccagagataaatgggggaaaactgcgctgcactgggctgctgccgtgaacaacgcccgagccgcccgctcgcttctccaggccggagccgataaagatgcccaggacaacagggagcagacgccgctattcctggcggcgcgggaaggagcggtggaagtagcccagctactgctggggctgggggcagcccgagagctgcgggaccaggctgggctagcgccggcggacgtcgctcaccaacgtaaccactgggatctgctgacgctgctggaaggggctgggccaccagaggcccgtcacaaagccacgccgggccgcgaggctgggcccttcccgcgcgcacggacggtgtcagtaagcgtgcccccgcatgggggcggggctctgccgcgctgccggacgctgtcagccggagcaggccctcgtgggggcggagcttgtctgcaggctcggacttggtccgtagacttggctgcgcgggggggcggggcctattctcattgccggagcctctcgggagtaggagcaggaggaggcccgacccctcgcggccgtaggttttctgcaggcatgcgcgggcctcggcccaaccctgcgataatgcgaggaagatacggagtggctgccgggcgcggaggcagggtctcaacggatgactggccctgtgattgggtggccctgggagcttgcggttctgcctccaacattccgatcccgcctccttgccttactccgtccccggagcggggatcacctcaacttgactgtggtcccccagccctccaagaaatgcccataaaccaaggaggagagggtaaaaaatagaagaatacatggtagggaggaattccaaaaatgattacccattaaaaggcaggctggaaggccttcctggttttaagatggatcccccaaaatgaagggttgtgagtttagtttctctcctaaaatgaatgtatgcccaccagagcagacatcttccacgtggagaagctgcagctctggaaagagggtttaagatgctaggatgaggcaggcccagtcctcctccagaaaataagacaggccacaggagggcagagtggagtggaaatacccctaagttggaaccaagaattgcaggcatatgggatgtaagatgttctttcctatatatggtttccaaagggtgcccctatgatccattgtccccactgcccacaaatggctgacaaatatttattgggcacctactatgtgccaggcactgtgtaggtgctgaaaagtggccaagggccacccccgctgatgactccttgcattccctcccctcacaacaaagaactccactgtggggatgaagcgcttcttctagccactgctatcgctatttaagaaccctaaatctgtcacccataataaagctgatttgaagtgtta

SEQ ID NO: 160145 - DNA, 1726 bp, Homo sapiens
  Payload ID: 11322
  Gene Symbol: NLE1
  Gene Name: notchless homolog 1 (Drosophila)
  ENST ID: ENST00000360831
  CDS Start-End: 29-1360
ctctttctcctccacgtggggacgcaggatggcggcagcagtgccggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaactt

SEQ ID NO: 160146 - DNA, 2588 bp, Homo sapiens
  Payload ID: 11322
  Gene Symbol: NLE1
  Gene Name: notchless homolog 1 (Drosophila)
  Uniprot ID: Q9NVX2
  ENST ID: ENST00000442241
  CDS Start-End: 41-1498
ctgtctgccgggctctttctcctccacgtggggacgcaggatggcggcagcagtgccggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaggaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaactagca

SEQ ID NO: 160147 - DNA, 580 bp, Homo sapiens
  Payload ID: 11322
  Gene Symbol: NLE1
  Gene Name: notchless homolog 1 (Drosophila)
  ENST ID: ENST00000588642
  CDS Start-End: 23-286
ctcctccacgtggggacgcaggatggcggcagcagtgccggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggtacctggccagtggctctggagacaccaccgtgcgcttctgggatctcagcacagagacaccacatttcacatgcaagggacacagacactgggtccttagtatatcctggtctccagatggcaggaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggct

SEQ ID NO: 160148 - DNA, 5286 bp, Homo sapiens
  Payload ID: 11322
  Gene Symbol: NLE1
  Gene Name: notchless homolog 1 (Drosophila)
  Uniprot ID: Q9NVX2
  ENST ID: ENST00000586869
  CDS Start-End: 1021-1602
ggacgcaggatggcggcagcagtgccggtgggtgtgcgtggatgggggcggggggcgtcgccgcggggcgctagggcccgggtccctgaggcctgagagaggcgaagtggggcccttctgggcgggcgaccagactgactcccgccccacttgctcgcgcaggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtacctggccagtggctctggagacaccaccgtgcgcttctgggatctcagcacagagacaccacatttcacatgcaagggacacagacactgggtccttagtatatcctggtctccagatggcaggaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaagtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacaccccagagccagaaatcgaaggtcacaggaagttgtcactgaacttggcccgtgtctgctactctgtaccttgctggtacagacaggggtggtgggcagccaggctctatgagtgggcccctagtgtcagctctgtacagggtcagatcccaggttctatgaccaaataagtaacttaagttttgtgtgttgggttctaattccttgtcctagaatccccatgactcaatcaaggactgtgctaaatgagattgtccagcccccgcccttgcactggactacgccaaaaccacactgaccaggcacttgccttccctctcttcccccgtgttggtaagagagaggccagttgtgatagtggccaaggagaatctagggctgtattgttgtccactgcagtaggcaccggccacatgtgactgctggcatgaaatagaagtgcagttcctccatcgcactgggtaaggcctccagtattggacagcacacagaaaggttttcatcatcaagagagttctgctggtcagccctgctccaggggatgcctctgccttcgcatagcacactgcttgaggccctgccaggcaccaagcactgccctgggcccatgggatagagcggggaaggtgatggctcttccagaggattccctcagatggggaggcagcagtatgagctctgagcagaagtgggtattgttgatacagaggaagttctttgccacgagaactttcaagcagtgaaaggaattcccatcaggactcagaccccaggccgagatcttgccctgaatgtaccctgcctctgctttctcctgcatcccatgctaagcagggtcatggtctgaactactcagattggatttccaaaccatccttgtataaactgctcagaactagcatcttgctccttcttaccctcctccacccttgtctgtgcttttgggttttgcgcgtcacctagctgtggtgcttggcctccaccttgcacatatctgcagtgaggctacataagaagcgaacaaaactatcagccactgagctccttggtgccagctgtttgtctgctgtgctctcagactgcaccaggcctggaaggttctcaagctccaaaacttttgatgaggaaacaacataagaaatgattagcccatgccctcacatctagtaagagaaagctgggattaaaccaggccctgccccaaagcttattgtgcactttgtaccacatccctccgtccagagctcaagctagtttgacagttcatgggccaccacgtctgtccatgacagctatttctgtatttttctggtgtaagagccttttagtcttagagcaccagtctccctgttcccctaccccgccccactggggaaggggtgatggcagcatcctattgcctagctgcctgttttctatctccccacccatgtagactctgtcctggtggaagctaggaggtgggtgccagccagcccatctgaggctgtctgcagcataaagcagactttagggtgctggatgacctgcagttctttaatgagggacctagacccagcccagatttggaggaggagggagtctagcagctgtgggcagtggctgagcctggcatggcctggcctgagatgcctccaggtgaatggggcccctatgtagccttggccccagcccaggggtggggtgcccataccactctgccagaccccgggcccgcagggtgctggtggtatggtaggtctcatggctctggtttctgagggcctggggttgaagctgaaagtaggtgaggggtgtcctggggccctcccccttaacagggaaataggtattccagatcctccagcctccgcatctcctccggcccgatggacacgatcttttgccggggttccttgcgccgcacggtgatctggatggggtagttctcaggaaagctgctgaagtcagtggccagggttgcaaactgaagtgaaacaagaaaacccttcagagttccttcccagatctgaacctggctctctctctgtctctatcaccccttttttttctgtctgctgactcagaccttaaacagccttatccaacctagccattgacgcaggaaacaggtgcaaagatgcatgactcaagcctgtacctcctcattatgggatatttccaaccaaagggctgtctgtactcaggcctctatacccccatacccctaccccatacccaggctgttcccttcttcgtccccctttagcctcttgtcttccctatttctttcaatgcccttgacttcccagcctactcacaatcatgggcactgaattgcagagtctaaaaaccaatggctttggaaggggaacattatagtgatgttgaaaaatacattcgtttgcattcctagtgggccccagagtggcttaatccttaaacctcccagaagcatgcattctggaattgatgcttcttgacccaggcagaaggaaagctagccagatgagtcatgtgggcataggggtgttcccaacctccaaagccctggttccctggctttggacttctctccacccccaaggcccctcttttcccagggctcactttgtagggcttgcaccacttccccaccccagctgtgttggctgcacggacactgaggcagtaacacgtgttaggctttagctccatcagcttgacagtagtgcccaaaatcttgttgaagatccatggacgattctttgcctcgggcaactcattctcctgtgtcttggccacctcctgtaacaggagctggtagaaactgaccggctgcttgcccaaggcgtaggtccaggaaatctaggggaagagagagccccgaggcttcctcagatatgtcctgtccttcctgtcccttcaccctcccaactggggtcaggacgtcccatgcccatcccctgctcctgctggggcccaggcaggtcagatggaaggtgcaaggtactgcagcactgagtgtggaacccctgccccgaagcatgtactactctcctgggcagccccacccactttagggtacaccctcattccatatttcttatacgccaggggtcctcaacccttgggccaccaactgatagcagtccatggcctgttaggaactggatagcacagcaggaggagattggtgggcgagcaagcgaagcttcatctgtatttacagctgctccccacggctcagggtaccacctgagctctgcctcctgtcagatcagcagaggcattagattcccataggcacgtgaaccctattgtgaattgtatgggagggatctaagttgaatgctccttatgagaatctaatgcctgatgatctgtcattgtctcccatcacccccaaatgggaccctctcgttgcaggaaaacaagctcagggctcccacagtttctacattatggtgagttgtataattatttcattatatattacaatgtaataataatagaaataaagtacacaataaatgt

SEQ ID NO: 160149 - DNA, 1107 bp, Homo sapiens
  Payload ID: 11322
  Gene Symbol: NLE1
  Gene Name: notchless homolog 1 (Drosophila)
  ENST ID: ENST00000588019
  CDS Start-End: 1-914
gcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaaggatccttgcaggagttgaaggagagggctctgagccgatacaacctcgtgcggggccagggtccagagaggctggtgtctggctccgacgacttcaccttattcctgtggtccccagcagaggacaaaaagcctctcactcggatgacaggacaccaagctctcatcaaccaggtgctcttctctcctgactcccgcatcgtggctagtgcctcctttgacaagtccatcaagctgtgggatggcaggacgggcaaagatgactttcactctgtcacctggtgttcaagtggctcgagtgcagcggcacgatcttggctcattacaacctctgcttcctgggttcaagtgattctcctgcctcagcctcccaggtacctggcttccctacgcggccacgtggctgccgtgtaccagattgcgtggtcagctgacagtcggctcctggtcagcggcagcagtgacagcacactgaaggtgtgggatgtgaaggcccagaagctggccatggacctgcccggccacgcggatgaggtatatgctgttgactggagtccagatggccagagagtggcaagtggtgggaaggacaaatgcctccggatatggaggagatgagacggcccgaagttctctctgacccccacctcgactcggcctctgccagctgccttccctgccagagaacaaaggctgagatggcagtgcacacaccctccccaccagtggggacctgagaatgcgtgtggcctgctgtcctcgatagaccggaatggggttttcccacagatccccgcctgtggcacacccc

SEQ ID NO: 160150 - DNA, 1017 bp, Homo sapiens
  Payload ID: 11322
  Gene Symbol: NLE1
  Gene Name: notchless homolog 1 (Drosophila)
  ENST ID: ENST00000589367
  CDS Start-End: 30-413
gctctttctcctccacgtggggacgcaggatggcggcagcagtgccggacgaggcggtggcgcgcgatgtgcagcggttgctagtgcagttccaggatgagggcgggcagctgctgggttccccgttcgacgtgcccgtggacatcaccccggacaggctgcagctcgtgtgcaacgcgctactggcccaggaggatcccctgccactggctttctttgtccacgatgctgagatcgtctcctcactggggaagacgttggagtcccaggcagtggagacagagaaggtcctagacatcatctaccagccacaggctatcttcagagtccgggctgtgactcgctgcaccagctccttggagggtcacagtgaggcagtcatttctgtggccttcagccctacgggaaagtaaggacagctgcagactcatggagggggtacctggccagtggctctggagacaccaccgtgcgcttctgggatctcagcacagagacaccacatttcacatgcaagggacacagacactgggtccttagtatatcctggtctccagatggcaggaagctggcctcaggctgcaagaatggccagattctcctctgggacccaagcacagggaagcaggtgggcaggaccctcgctggccacagcaagtggatcacaggcctgagctgggagcccctccatgcgaaccctgagtgccgctatgtggccagcagctccaaggatggcagtgtgcggatctgggacacaactgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacaccatggccctcagcactgactatgccctgcgcactggggcctttgaacctgctgaggcctcagttaatccccaagacctccaagg

SEQ ID NO: 160151 - DNA, 1770 bp, Homo sapiens
  Payload ID: 11323
  Gene Symbol: NRARP
  Gene Name: NOTCH-regulated ankyrin repeat protein
  Uniprot ID: Q7Z6K4
  ENST ID: ENST00000356628
  CDS Start-End: 324-668
ggcgccttgggaccgcgtgggagccgcagccgaaccgagtagggaccgggaccgcgcggcgccgccgtccccggccgggcccggcccccgcgagccgagcgcgcgcccccgtcgcccacccgggcgcggctggatgcggcggggtccccgcggcggcgacccccggccccgagcgcccggagcgcccagaggcggcgtgcggggcccggggacgccgcgccctccatgcgccgaggcgcgccccgagacagccgggggcccgcgccgcagccgccgcccgcgctgagccccggcccggcccgcggcccgcgcccggcggcagcatgagccaggccgagctgtccacctgctccgcgccgcagacgcagcgcatcttccaggaggctgtgcgcaagggcaacacgcaggagctgcagtcgctgctgcagaacatgaccaactgcgagttcaacgtgaactcgttcgggcccgagggccagacggcgctgcaccagtcggtcatcgacggcaacctggagctcgtgaagctgctggtcaagttcggcgccgacatccgcctggccaaccgcgacggctggagcgcgctgcacatcgccgcgttcggtggccaccaggacatcgtgctctatctcatcaccaaggcgaagtacgcggccagcggccggtgatgcccgccgggaccccggaccccggccctgcgcccgcgtcgtctctgctgtaccttcccgccaactacctcggtgcgcgcccggctcgcaggccccgccagaaggcccgtggccacggcgaatacggcgcgtgcgtcccggccccagggtccggcagccccgccggccgagcgcctccctgcggcctagccgggcccggccgggccggagcagcttcccacggcccccacccgctcgcctgcccgccgcctcgcgggtgggggcggggcgcgggctccagccccttttgaaatttgagtctcgcaaccagcaagttcggaatcccgagataccggatcctctgcgcaaaatgttttctcccgaaggtgaaaggcgggcggcgggagccgaaggcggactcggagcgctccgccgccgccttcaggacccgcccgcaggcccgggacgcgccgatgccggctgcagccgaggagcagccccgaggtccgaggtccgcgccgctggcgcgcggccgaggagacgctcggctgttcgctgttgctggtgttctaaactatttatcttgtgtgtgtacatttgtgggtggagtttgtgcgcctggtttttttgtttggaaaacactgcgtggtcaatgtggttatgggggggagtgatgcatttttttctagtcttaaaactaaaaacttgagtctaccatttcttggttgcactgaaaataccgcccagcctgatggtgttcccgtgctgtccctcccccttcccttctccccgcgtctacctccccaccccgttctgttccccctccctccttctccctctccctcaaatccgtgagttttggaagccccagggcctctctcccccgcccctcctggatgaggccaccatcccccaaaccggcttgttttgcagtttccccaggatcctggaagctcgctggcgctcgagggtggcggggacacgggggggtgggtgaaggttcgttaccttttctagtgcgttctatcatagttaacggttgcacacttttttaaaaaaagtaaatggatttgccacaattaaatgtcataacatttatgacagaatataaaatattaacata

SEQ ID NO: 160152 - DNA, 2749 bp, Homo sapiens
  Payload ID: 11324
  Gene Symbol: NOTO
  Gene Name: notochord homeobox
  Uniprot ID: A8MTQ0
  ENST ID: ENST00000398468
  CDS Start-End: 410-1165
agctccgcctctgcaaggccccggggaaacgggcatcccttcttcagtgagcaaaggagaaagacggagcccggtggctgggtgtttcgcccaggatcaccagcgagctcagagtcctccccacgaccgccccagggtgggcatttttaaaagcggaggaagggagggaacacactctttggtgctgtgcccaccttgcctcgcacagagcgggcgctcacaggctttgggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccggacgcttcgagtcccctttctcggtcgaggccatcctggcgaggcccgacccctgcgcgccggcggcctcccagccgtcgggctccgcctgcgtccacccggccttctggaccgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacagggttggagctggctcactgctcaggactctgggccttcccagactgggccccaacggaggacctacaggacactgagagacagcaaaagagagtccgaactatgtttaacttggagcagctggaagagttggagaaagtgtttgcaaaacagcacaatctggtggggaagaagagagcccagctggcagctcggctcaaacttacagagaaccaggtgagagtctggttccagaaccgcagggtcaagtatcagaagcagcaaaagctgagggcagcagttacatctgccgaggctgcctccctggatgagccttccagcagctccatcgccagtatccagagtgatgatgccgagtcaggagtggacggctgaagactgggacagaggccctagccaggctgcctggactagttcctcctgggggtacccactggagctccctgcctcacacctcaacgaaaagcctcctcaaccagaagaatctgagctgtcaagcagggacccccttttctatactgattcctggaaactggaataatgtaatgattggaggcacagactctggccttcagctatgtccttggccaacctatggaacttccgagccttttttctttatctgtataatgggtgcattcataacttagatcacccaggggtgagaagatgtctgtaaagcaataatgtgccatgcacagtgcaaagtgtgtggttactgttaaggcttgtaggcccctgagtagagaagaccaactggaaaaaaaaaagtttttttcttctgctgtcaccccacaacaatcaacacagaacacttctgtgaccaaacgtataggggtgtaccccacattccaacctccagttcagcaaattctgacatgatctacctgcaggtagtgtctgaccccacagattcagggctcattccacatggcagcccctcctttcttttttttttgagacagactgcagtggcgcgatcttggctcaccgccacctccgcctcccgggttcaagcgattctcctgcctcagcctcccgagcagctgggactataggcgcatgccaccatgcctggctaatttttatatttttagtagagacggggtttcatcatatggtcaggctggtcttgaactgctgaccttgtgatccacccacctcggcctcccaaagtgctgggattacatgtgtgagccaccacccggcccaaccctgccctttttgttttttatggagtcttaaggtctaccagtcatcagtcaactcattagcatatgaaaagacatcacttcagagattctagggattttaggagttctatgccaggaaatcgagatgaagaccaaatatatatttcataatatcacagctcccctcacctgggggagtaatacctgtaccagcaattaatattttcctggcctggctgtggagaaggaacctctttgaataagcatctgggcatagaagactcttcaccatcagaaggagttgagagcaaagaagagaaggtagactgtttagcccacttcacaaagtttcccaacgttttcttgttttgtctgaactgttaccattctcagaagaagctcaggcccagcagcaaagacaaggactcgctctgtcacccagactggagtgcagtggtgcaatcatagctcacggcagcctcaacctcctgggctctagtgatcctcccaccttagcctcctaagcagctgggactacaggcgcgtgacaccacgcctggctaatttttaacattttttgtagagacaacgtccacttgttgcccaggctggtcttgaattccaggcttcaagtggttctcctgccttggcctcccaaagccccatctttttatagaataatttgtgtatgccaaggctggcattttgtcataaactctgctgtgttttcacaggacagttataatttccccctttcatgactctg

SEQ ID NO: 160153 - DNA, 2329 bp, Homo sapiens
  Payload ID: 11325
  Gene Symbol: NOTUM
  Gene Name: notum pectinacetylesterase homolog (Drosophila)
  Uniprot ID: Q6P988
  ENST ID: ENST00000409678
  CDS Start-End: 385-1875
ctcccccctccgccgagcccgggcggcggcggcggcacatctaacgcgcgggcacccgggccgccgcggcccccgcaaataagcccagcctcggcccccgccgctcattggcgcgggccgcagccagcgcacccagaccctgcgctgccctcggacggccgggcgcggagccccagctgcggaggccgacggcacccggccccgagcgcctcgacgccgagccgcgcgcgccttctccgccaggcccggcgggcgggagcgggggcgagggagcaggagcggccagtgcccccgacacccccggcccggcacccccggcccggcatcccccgccgccgccgccgccgcctcaaggccgcccgctccccgcaggtggacgcggccatgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaacctca

SEQ ID NO: 160154 - DNA, 996 bp, Homo sapiens
  Payload ID: 11325
  Gene Symbol: NOTUM
  Gene Name: notum pectinacetylesterase homolog (Drosophila)
  ENST ID: ENST00000425009
  CDS Start-End: 110-996
agagggggagcgcagccgagccgggcgcaccagcgggacggcgcagggccaggggcgctgagaggacggggccactgggccgcccgcgctggccgcggtggacgcggccatgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcag

SEQ ID NO: 160155 - DNA, 813 bp, Homo sapiens
  Payload ID: 11325
  Gene Symbol: NOTUM
  Gene Name: notum pectinacetylesterase homolog (Drosophila)
  ENST ID: ENST00000477214
  CDS Start-End: 222-813
gtgcgaccgtcgcgcgcggccggaacaggtggcgcgttccctccgccggagctgggcgcgcggggcgcggcgggtcggcagccctggccgaccccccgcggtgcgtcctcccccgcagctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttg

SEQ ID NO: 160156 - DNA, 5048 bp, Homo sapiens
  Payload ID: 11326
  Gene Symbol: NPC1L1
  Gene Name: NPC1-like 1
  Uniprot ID: Q9UHC9
  ENST ID: ENST00000289547
  CDS Start-End: 57-4136
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccagaggctgccccggaggcctggggagccacgagaggtccacattgggcgagccctaggcagggtggctcccagcatgctgttgtgcagcctctctgaggccatctgcttcttcctaggggccctgacccccatgccagctgtgcggacctttgccctgacctctggccttgcagtgatccttgacttcctcctgcagatgtcagcctttgtggccctgctctccctggacagcaagaggcaggaggcctcccggttggacgtctgctgctgtgtcaagccccaggagctgcccccgcctggccagggagaggggctcctgcttggcttcttccaaaaggcttatgcccccttcctgctgcactggatcactcgaggtgttgtgctgctgctgtttctcgccctgttcggagtgagcctctactccatgtgccacatcagcgtgggactggaccaggagctggccctgcccaaggactcgtacctgcttgactatttcctctttctgaaccgctacttcgaggtgggggccccggtgtactttgttaccaccttgggctacaacttctccagcgaggctgggatgaatgccatctgctccagtgcaggctgcaacaacttctccttcacccagaagatccagtatgccacagagttccctgagcagtcttacctggccatccctgcctcctcctgggtggatgacttcattgactggctgaccccgtcctcctgctgccgcctttatatatctggccccaataaggacaagttctgcccctcgaccgtcaactctctgaactgcctaaagaactgcatgagcatcacgatgggctctgtgaggccctcggtggagcagttccataagtatcttccctggttcctgaacgaccggcccaacatcaaatgtcccaaaggcggcctggcagcatacagcacctctgtgaacttgacttcagatggccaggttttagacacagttgccattctgtcacccaggctggagtacagtggcacaatctcggctcactgcaacctctacctcctggattcaacctccaggttcatggcctatcacaagcccctgaaaaactcacaggattacacagaagctctgcgggcagctcgagagctggcagccaacatcactgctgacctgcggaaagtgcctggaacagacccggcttttgaggtcttcccctacacgatcaccaatgtgttttatgagcagtacctgaccatcctccctgaggggctcttcatgctcagcctctgccttgtgcccaccttcgctgtctcctgcctcctgctgggcctggacctgcgctccggcctcctcaacctgctctccattgtcatgatcctcgtggacactgtcggcttcatggccctgtggggcatcagttacaatgctgtgtccctcatcaacctggtctcggcggtgggcatgtctgtggagtttgtgtcccacattacccgctcctttgccatcagcaccaagcccacctggctggagagggccaaagaggccaccatctctatgggaagtgcggtgtttgcaggtgtggccatgaccaacctgcctggcatccttgtcctgggcctcgccaaggcccagctcattcagatcttcttcttccgcctcaacctcctgatcactctgctgggcctgctgcatggcttggtcttcctgcccgtcatcctcagctacgtggggcctgacgttaacccggctctggcactggagcagaagcgggctgaggaggcggtggcagcagtcatggtggcctcttgcccaaatcacccctcccgagtctccacagctgacaacatctatgtcaaccacagctttgaaggttctatcaaaggtgctggtgccatcagcaacttcttgcccaacaatgggcggcagttctgatacagccagaggccctgtctaggctctatggccctgaaccaaagggttatggggatcttccttgtgactgccccttgacacacgccctcctcaaatcctaggggaggccattcccatgagactgcctgtcactggaggatggcctgctcttgaggtatccaggcagcaccactgatggctcctctgctcccatagtgggtccccagtttccaagtcacctaggccttgggcagtgcctcctcctgggcctgggtctggaagttggcaggaacagacacactccatgtttgtcccacactcactcactttcctaggagcccacttctcatccaacttttcccttctcagttcctctctcgaaagtcttaattctgtgtcagtaagtctttaacacgtagcagtgtccctgagaacacagacaatgaccactaccctgggtgtgatatcacaggaggccagagagaggcaaaggctcaggccaagagccaacgctgtgggaggccggtcggcagccactccctccagggcgcacctgcaggtctgccatccacggccttttctggcaagagaagggcccaggaaggatgctctcataaggcccaggaaggatgctctcataagcaccttggtcatggattagcccctcctggaaaatggtgttgggtttggtctccagctccaatacttattaaggctgttgctgccagtcaaggccacccaggagtctgaaggctgggagctcttggggctgggctggtcctcccatcttcacctcgggcctggatcccaggcctcaaaccagcccaacccgagcttttggacagctctccagaagcatgaactgcagtggagatgaagatcctggctctgtgctgtgcacataggtgtttaataaacatttgttggcagaaa

SEQ ID NO: 160157 - DNA, 4141 bp, Homo sapiens
  Payload ID: 11326
  Gene Symbol: NPC1L1
  Gene Name: NPC1-like 1
  ENST ID: ENST00000381160
  CDS Start-End: 57-4055
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccagaggctgccccggaggcctggggagccacgagaggtccacattgggcgagccctaggcagggtggctcccagcatgctgttgtgcagcctctctgaggccatctgcttcttcctaggggccctgacccccatgccagctgtgcggacctttgccctgacctctggccttgcagtgatccttgacttcctcctgcagatgtcagcctttgtggccctgctctccctggacagcaagaggcaggaggcctcccggttggacgtctgctgctgtgtcaagccccaggagctgcccccgcctggccagggagaggggctcctgcttggcttcttccaaaaggcttatgcccccttcctgctgcactggatcactcgaggtgttgtgctgctgctgtttctcgccctgttcggagtgagcctctactccatgtgccacatcagcgtgggactggaccaggagctggccctgcccaaggactcgtacctgcttgactatttcctctttctgaaccgctacttcgaggtgggggccccggtgtactttgttaccaccttgggctacaacttctccagcgaggctgggatgaatgccatctgctccagtgcaggctgcaacaacttctccttcacccagaagatccagtatgccacagagttccctgagcagtcttacctggccatccctgcctcctcctgggtggatgacttcattgactggctgaccccgtcctcctgctgccgcctttatatatctggccccaataaggacaagttctgcccctcgaccgtcaactctctgaactgcctaaagaactgcatgagcatcacgatgggctctgtgaggccctcggtggagcagttccataagtatcttccctggttcctgaacgaccggcccaacatcaaatgtcccaaaggcggcctggcagcatacagcacctctgtgaacttgacttcagatggccaggttttagcctccaggttcatggcctatcacaagcccctgaaaaactcacaggattacacagaagctctgcgggcagctcgagagctggcagccaacatcactgctgacctgcggaaagtgcctggaacagacccggcttttgaggtcttcccctacacgatcaccaatgtgttttatgagcagtacctgaccatcctccctgaggggctcttcatgctcagcctctgccttgtgcccaccttcgctgtctcctgcctcctgctgggcctggacctgcgctccggcctcctcaacctgctctccattgtcatgatcctcgtggacactgtcggcttcatggccctgtggggcatcagttacaatgctgtgtccctcatcaacctggtctcggcggtgggcatgtctgtggagtttgtgtcccacattacccgctcctttgccatcagcaccaagcccacctggctggagagggccaaagaggccaccatctctatgggaagtgcggtgtttgcaggtgtggccatgaccaacctgcctggcatccttgtcctgggcctcgccaaggcccagctcattcagatcttcttcttccgcctcaacctcctgatcactctgctgggcctgctgcatggcttggtcttcctgcccgtcatcctcagctacgtggggcctgacgttaacccggctctggcactggagcagaagcgggctgaggaggcggtggcagcagtcatggtggcctcttgcccaaatcacccctcccgagtctccacagctgacaacatctatgtcaaccacagctttgaaggttctatcaaaggtgctggtgccatcagcaacttcttgcccaacaatgggcggcagttctgatacagccagaggccctgtctaggctctatggccctgaaccaaagggttatggggatcttccttgtgactgccccttgacacacgcc

SEQ ID NO: 160158 - DNA, 2554 bp, Homo sapiens
  Payload ID: 11326
  Gene Symbol: NPC1L1
  Gene Name: NPC1-like 1
  Uniprot ID: Q9UHC9
  ENST ID: ENST00000423141
  CDS Start-End: 57-2231
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccaggggccctgacccccatgccagctgtgcggacctttgccctgacctctggccttgcagtgatccttgacttcctcctgcagatgtcagcctttgtggccctgctctccctggacagcaagaggcaggaggtaggggcagctgggccagtactgagggacctgcccctgggttcccaccatggcagggagatggggtggctttaccaccacagagatggcccagagaatggggtgggggacaggggcattgtgccaggagagtaatatttaggccatgtattctccaatttcctacagaaaaataaatttgttttgacaattttttaaatataa

SEQ ID NO: 160159 - DNA, 4826 bp, Homo sapiens
  Payload ID: 11326
  Gene Symbol: NPC1L1
  Gene Name: NPC1-like 1
  ENST ID: ENST00000546276
  CDS Start-End: 57-3917
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatcacaggtgatcacctgatcctattacagaagatctgcccccgcctctacaccggccccaacacccaagcctgctgctccgccaagcagctggtatcactggaagcgagtctgtcgatcaccaaggccctcctcacccgctgcccagcctgctctgacaattttgtgaacctgcactgccacaacacgtgcagccccaatcagagcctcttcatcaatgtgacccgcgtggcccagctaggggctggacaactcccagctgtggtggcctatgaggccttctaccagcatagctttgccgagcagagctatgactcctgcagccgtgtgcgcgtccctgcagctgccacgctggctgtgggcaccatgtgtggcgtgtatggctctgccctttgcaatgcccagcgctggctcaacttccagggagacacaggcaatggtctggccccactggacatcaccttccacctcttggagcctggccaggccgtggggagtgggattcagcctctgaatgagggggttgcacgttgcaatgagtcccaaggtgacgacgtggcgacctgctcctgccaagactgtgctgcatcctgtcctgccatagcccgcccccaggccctcgactccaccttctacctgggccagatgccgggcagtctggtcctcatcatcatcctctgctctgtcttcgctgtggtcaccatcctgcttgtgggattccgtgtggcccccgccagggacaaaagcaagatggtggaccccaagaagggcaccagcctctctgacaagctcagcttctccacccacaccctccttggccagttcttccagggctggggcacgtgggtggcttcgtggcctctgaccatcttggtgctatctgtcatcccggtggtggccttggcagcgggcctggtctttacagaactcactacggaccccgtggagctgtggtcggcccccaacagccaagcccggagtgagaaagctttccatgaccagcatttcggccccttcttccgaaccaaccaggtgatcctgacggctcctaaccggtccagctacaggtatgactctctgctgctggggcccaagaacttcagcggaatcctggacctggacttgctgctggagctgctagagctgcaggagaggctgcggcacctccaggtatggtcgcccgaagcacagcgcaacatctccctgcaggacatctgctacgcccccctcaatccggacaataccagtctctacgactgctgcatcaacagcctcctgcagtatttccagaacaaccgcacgctcctgctgctcacagccaaccagacactgatggggcagacctcccaagtcgactggaaggaccattttctgtactgtgccaatgccccgctcaccttcaaggatggcacagccctggccctgagctgcatggctgactacggggcccctgtcttccccttccttgccattggggggtacaaaggaaaggactattctgaggcagaggccctgatcatgacgttctccctcaacaattaccctgccggggacccccgtctggcccaggccaagctgtgggaggaggccttcttagaggaaatgcgagccttccagcgtcggatggctggcatgttccaggtcacgttcatggctgagcgctctctggaagacgagatcaatcgcaccacagctgaagacctgcccatctttgccaccagctacattgtcatattcctgtacatctctctggccctgggcagctattccagctggagccgagtgatggtggactccaaggccacgctgggcctcggcggggtggccgtggtcctgggagcagtcatggctgccatgggcttcttctcctacttgggtatccgctcctccctggtcatcctgcaagtggttcctttcctggtgctgtccgtgggggctgataacatcttcatctttgttctcgagtaccagaggctgccccggaggcctggggagccacgagaggtccacattgggcgagccctaggcagggtggctcccagcatgctgttgtgcagcctctctgaggccatctgcttcttcctaggggccctgacccccatgccagctgtgcggacctttgccctgacctctggccttgcagtgatccttgacttcctcctgcagatgtcagcctttgtggccctgctctccctggacagcaagaggcaggaggcctcccggttggacgtctgctgctgtgtcaagccccaggagctgcccccgcctggccagggagaggggctcctgcttggcttcttccaaaaggcttatgcccccttcctgctgcactggatcactcgaggtgttgtggtgggggccccggtgtactttgttaccaccttgggctacaacttctccagcgaggctgggatgaatgccatctgctccagtgcaggctgcaacaacttctccttcacccagaagatccagtatgccacagagttccctgagcagtcttacctggccatccctgcctcctcctgggtggatgacttcattgactggctgaccccgtcctcctgctgccgcctttatatatctggccccaataaggacaagttctgcccctcgaccgtcaactctctgaactgcctaaagaactgcatgagcatcacgatgggctctgtgaggccctcggtggagcagttccataagtatcttccctggttcctgaacgaccggcccaacatcaaatgtcccaaaggcggcctggcagcatacagcacctctgtgaacttgacttcagatggccaggttttagcctccaggttcatggcctatcacaagcccctgaaaaactcacaggattacacagaagctctgcgggcagctcgagagctggcagccaacatcactgctgacctgcggaaagtgcctggaacagacccggcttttgaggtcttcccctacacgatcaccaatgtgttttatgagcagtacctgaccatcctccctgaggggctcttcatgctcagcctctgccttgtgcccaccttcgctgtctcctgcctcctgctgggcctggacctgcgctccggcctcctcaacctgctctccattgtcatgatcctcgtggacactgtcggcttcatggccctgtggggcatcagttacaatgctgtgtccctcatcaacctggtctcggcggtgggcatgtctgtggagtttgtgtcccacattacccgctcctttgccatcagcaccaagcccacctggctggagagggccaaagaggccaccatctctatgggaagtgcggtgtttgcaggtgtggccatgaccaacctgcctggcatccttgtcctgggcctcgccaaggcccagctcattcagatcttcttcttccgcctcaacctcctgatcactctgctgggcctgctgcatggcttggtcttcctgcccgtcatcctcagctacgtggggcctgacgttaacccggctctggcactggagcagaagcgggctgaggaggcggtggcagcagtcatggtggcctcttgcccaaatcacccctcccgagtctccacagctgacaacatctatgtcaaccacagctttgaaggttctatcaaaggtgctggtgccatcagcaacttcttgcccaacaatgggcggcagttctgatacagccagaggccctgtctaggctctatggccctgaaccaaagggttatggggatcttccttgtgactgccccttgacacacgccctcctcaaatcctaggggaggccattcccatgagactgcctgtcactggaggatggcctgctcttgaggtatccaggcagcaccactgatggctcctctgctcccatagtgggtccccagtttccaagtcacctaggccttgggcagtgcctcctcctgggcctgggtctggaagttggcaggaacagacacactccatgtttgtcccacactcactcactttcctaggagcccacttctcatccaacttttcccttctcagttcctctctcgaaagtcttaattctgtgtcagtaagtctttaacacgtagcagtgtccctgagaacacagacaatgaccactaccctgggtgtgatatcacaggaggccagagagaggcaaaggctcaggccaagagccaacgctgtgggaggccggtcggcagccactccctccagggcgcacctgcaggtctgccatccacggccttttctggcaagagaagggcccaggaaggatgctctcataaggcccaggaaggatgctctcataagcaccttggtcatggattagcccctcctggaaaatggtgttgggtttggtctccagctccaatacttattaaggctgttgctgccagtcaaggccacccaggagtctgaaggctgggagctcttggggctgggctggtcctcccatcttcacctcgggcctggatcccaggcctcaaaccagcccaacccgagcttttggacagctctccagaagcatgaactgcagtggagatgaagatcctggctctgtgctgtgcacataggtgtttaataaacatttgttggcag

SEQ ID NO: 160160 - DNA, 782 bp, Homo sapiens
  Payload ID: 11327
  Gene Symbol: NPHP3-ACAD11
  Gene Name: NPHP3-ACAD11 readthrough (NMD candidate)
  ENST ID: ENST00000383282
  CDS Start-End: 60-512
gttccgttccgctgcccagtcctgctggtactcactaggtagtagcggcaacggacgccatggggaccgcctcgtcgctcgtgagccccgcgggcggggaagtgatcgaggacacgtacggggcgggcggcggcgaggcctgcgagatcccggtggaggtgaagcccaaggcccgcctgctgcgcaactcgttccgccgaggcgcgggggcggcagcaggggccgggcccgggtcgctgccccgcggggtgggcgcgggcgggctgctgggggccagcttcaagtccactggctcgtcggtgccagagctggagtacgcggcggccgagtacgagcggctcaggaaggagtacgagatctttcgcgtcagcaagaaccaggagttgttgtccatgggccgccgcgaggccaagctggacacggagaacaagcggctgcgggccgaactgcagggtctcgctgcggtggcacgatcgcggctcactgcaacctggaactcctgggctcaatgatcctcccgcctcggcctcctaaagttctgggattacaggagtgagccaccgcgcctggtccccgcttttctatttctggtttattcattgaggcacctagaagaaattagccggaaagtgtcctgaggaggcaaatgccaatctccagctccactgccgcccccgcgcccaccccctcagaaggctggtgacatctgttgaagcaactcagcaaactcttcctaggagtttcacccccctccccaccataaaaattttaagtgggtctcc

SEQ ID NO: 160161 - DNA, 7784 bp, Homo sapiens
  Payload ID: 11327
  Gene Symbol: NPHP3-ACAD11
  Gene Name: NPHP3-ACAD11 readthrough (NMD candidate)
  ENST ID: ENST00000471702
  CDS Start-End: 105-2015
ctgccccgccccgtcccgttccgttcctctgccccaccccgtcccgttccgttccgctgcccagtcctgctggtactcactaggtagtagcggcaacggacgccatggggaccgcctcgtcgctcgtgagccccgcgggcggggaagtgatcgaggacacgtacggggcgggcggcggcgaggcctgcgagatcccggtggaggtgaagcccaaggcccgcctgctgcgcaactcgttccgccgaggcgcgggggcggcagcaggggccgggcccgggtcgctgccccgcggggtgggcgcgggcgggctgctgggggccagcttcaagtccactggctcgtcggtgccagagctggagtacgcggcggccgagtacgagcggctcaggaaggagtacgagatctttcgcgtcagcaagaaccaggagttgttgtccatgggccgccgcgaggccaagctggacacggagaacaagcggctgcgggccgaactgcaggcacttcaaaaaacgtatcagaagatacttcgagaaaaagaaagtgctttagaagcgaaataccaagcaatggagagagcagcaacatttgaacatgacagagataaagttaaaaggcaattcaagatttttagggagaccaaagaaaatgaaattcaggacttactgagggccaagagggagttggagagcaaacttcagaggctacaggctcagggtatccaagtatttgatcctggggagtctgattcagatgacaactgtacagatgtcactgctgctggaacccaatgtgaatattggactggcggagccttgggaagtgaaccttccataggaagcatgatccagcttcagcagtccttcagaggccctgagtttgcccatagttctatagatgtggaaggaccctttgcaaatgttaatagagatgactgggatattgctgtagctagtttattacaagttactcctctgttttcacattctctgtggagtaacactgtcagatgttacctcatttatacagatgaaacccagcctgagatggatcttttccttaaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcaggttgtggcctacacttcatcttgatcccttaagtccaaaagatgcaaaatctattataattgcagaatgccactctgtagacattaaattgagtaaagagcaggagaagaagctagaacgacactgtcgttctgctacaacctgcaatgccctttatgtcacccttttcggcaaaatgatcgcgcgtgctgggagagcaggcaatttagataaaatccttcatcagtgtttccagtgtcaagatactctttcattatatagacttgttctgcactctatccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggaaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacattccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaagattatgagactgatgcactgccctactgcgctaaggaggcaacctcctctttctaagagcttttctttctctttaatgttctgtagttttactatgctctggcttcattggctttccgaatttgaggattgctgtcttatcagttccgaaaacttttaagagaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggagctgggaatcccaagtgcaaaattgcaattgttttgggaagaactcaaaatacttctctctccaggtaattaaacaattctgattgagaaacctgtgtaggaatgagccagtcttcctcctatctaggtaatttacttaaaattcactgtttggactcacaaatcataatgtaagatatgagagtaaatgtcatatatttgtatttcacaagtattttctaacaggtgtttttggaaaacattatagggagtattgctgaacattcttcgctgtggaattttcagtattagaaagtgttgctaaattatcaaagctgtttggattaaattatcagacaaattttttcagacctgtgtaatgaagtgattagatgtttagatcaaaggcaataatcttgaaatgtttaattatatatataagttcccagttaccattgttgagcagtgagaagcttcaatcaaacaactcatttattttcaaatcattgtttctgttccagatcacagcctgcatcagactatgttggtgtacgtcttttacacagttcccattccagtcatcactgcttacatgactacatgaaaacatcaaaaagacaattgtgattctgcttattatctgttttatttttcttcttagcaaactttttctaatacaatttttcttttgactagacacaaacagcacagcatgattcttgttcccatgaacacacctggagtaaaaataataaggcctttgtcagtttttggctacacagataattttcatggaggacattttgagatccattttaatcaagtgcgagttcctgccacaaatctaatactaggtgaaggtaggggatttgaaatttcccaaggccgccttggacctggcagaatccaccactgtatgagaacagtaggtttggcggaacgcgctttgcagatcatgtgtgagcgggcaacacaaaggatagctttcaagaagaagttgtatgcacatgaggttgtggctcactggattgctgaaagccgcattgccattgagaagatccgcttgttgactctgaaagctgctcacagcatggacactctgggcagtgctggcgctaagaaagagattgcaatgatcaaagtggctgccccacgggctgtcagcaaaatcgttgactgggccatccaggtgtgcggaggtgctggtgtttcccaggattaccctctggctaacatgtatgctataacccgagttttgcgtttagcagatggacctgacgaagttcatctttcagcaatcgcaacaatggagctgcgggaccaagccaaaagactgacagccaagatataaggagggtggcactgccacatcccactggcagaaactctcctttatacaaacttcattggctccaacatttgaatctcatatttttgtagcagtttgagcacagggttaattattcatttgtggtaaagattatagcatctattttgatcagtgggttttattatttcaagggtcacacagggttaagttcagtaagaaatgctgtagctgttgtcattcaatctagtgcctccttgaggccaggagttcaggaccagcctgggcaacatagcgagacccccattgctacaaaaaatttaaaaatgaaacaagtgtggtggcacatgcttgtagtcctagctacttgggaggctgaggcaggaggattgcttgagtctaggagtttgaggttacagtaagctgtgatcgtgacatggcctccagcctgggtgaccgagtgagactgtttctaaaaataaaaacaaaaaataaatttcttcttgaggtggggtggaggtggggagcaagaatttgacctggctctgatccctggtgtgttgtgtgggcctctttaacgtttgccactgagccttaacctcactgtacttcactgtacttcacacgcattggtgttaacattttaatcttagaagaccctgacccactgagggtttgttgtgagaattgctgaagccacgtagaagcaccttgaaatctgtaaaaccacaagaaagtactttataaaaggtatccttatttgaagtggataaatcttgtaactcgaaaagttgtgatttagaagacaggattgtttttgaacattaggaattaaaggctatatctggtcctt

SEQ ID NO: 160162 - DNA, 695 bp, Homo sapiens
  Payload ID: 11327
  Gene Symbol: NPHP3-ACAD11
  Gene Name: NPHP3-ACAD11 readthrough (NMD candidate)
  ENST ID: ENST00000632629
  CDS Start-End: 1-695
ttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaagagcaggaaagtccaatccaaccttttatctccagaagggctttcaaacatatgtgctca

SEQ ID NO: 160163 - DNA, 4415 bp, Homo sapiens
  Payload ID: 11328
  Gene Symbol: NPLOC4
  Gene Name: NPL4 homolog, ubiquitin recognition factor
  Uniprot ID: Q8TAT6
  ENST ID: ENST00000331134
  CDS Start-End: 217-2043
aacctggtttcccggcctcgcgcccgaggggagcgtattgagcgaggcaccgggacgtcggcggctggcggagccgggcgggcgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggccgatgctgccaccacccagccttctctttattttcagtgctttttgtttggcctccctgcccccatgtttttctggctgggagctcttggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcatggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 160164 - DNA, 5538 bp, Homo sapiens
  Payload ID: 11328
  Gene Symbol: NPLOC4
  Gene Name: NPL4 homolog, ubiquitin recognition factor
  Uniprot ID: Q8TAT6
  ENST ID: ENST00000374747
  CDS Start-End: 131-1984
gctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgtttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgtttattatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgtgtgtgtgtgtgttttgagctggagcctcaccctgtctcccaggctggagtgcagtggcgcaatcttagctcactgcaaactctgcctcctgggttgaagcaattcccctccctcagcctcccgagtagctgggattacagatgtgtaccaccacacctggcgttgccatctttatgtacgtgagtacccatgtttagctcccacttataaatgaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctaacaatgacaccagtcttttttttttttttcttttttgtttcccttttagagacagggtttcactctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcaggtggatcacaacgtcaagggattgagaccatcctggccaacatggtgaaaccccatttctgttaaaactacaaaaattagctgggcatggtggcgagcgcctgtaatcccagctactcaggaggctgaggcaggagaatcacttgacccaggaagcgtaggttgtagtgagctgagatcgtgccactgtactccagcctgggcgacagagcaagactctgtctcaaaaaaaaaaaaaagatgtggtcttgccatgttgcccaggctggtctcaaactcctaggctcaagtgatcttcctgccttggttcccaaagtgctgagattacagctgtgagccactgcacctgaccttttttttttcccccctccttttttttttgagacaggttctcactctgtcacccaggctgaagtgcagtggcatttgaggtcagtctcaccttgacctccccaggctcaaacaatcctcccgcctcagcctcctgagcagctgggactacaagcatgtgccaccatccctggctgattttttaaatttgttgtagagatgaggtctcactatgttgcccaggctggtcttgaactcttgggcccaagcgatcctcccgcctcagtgctgagattgcagtggtaagccaccatgtccagccaactctttaataataggcagttctgactggtgtaagttctgactggtatctcactgtggttttaatttgcatctctgatgattagtgatgttgggcattttttcatgggttttttgtttgtttgttttgagacaaagtcttgttctgttgcccaggctggagtgcagtagtgtgatctcagctcactgcagcctccacctcccgggttcaagccattgtccagcctctgcctcctaagtagctggaattacaggtggctgccaccacacccagctaatttttttagttttagtagagacagggtttctccatgttggccaggctggtctcaaactcctgacctcaagtgatccacccacctcggcttcccaaagtgctgggattataggtgtgagccaccgcgcccggccctcatgggttgttttgttttgttttgagacggaatctcaccctgtcacccaggctgcagtgcaatctcatgatctccacttactgcaacctccacgtcctgggttcaagtgatactcctgcctcagcctcccgagtagctgggactacaggcgtgcacccacgcctggctaatttttatatttttagtagagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatatt

SEQ ID NO: 160165 - DNA, 559 bp, Homo sapiens
  Payload ID: 11328
  Gene Symbol: NPLOC4
  Gene Name: NPL4 homolog, ubiquitin recognition factor
  ENST ID: ENST00000572824
  CDS Start-End: 1-518
tttacactttttctatttcgcaaaatccatttcctattgaaaaccgggatgtattgggtgagacacagacagagtctcactctatcacccaggctggagtgcagtggtgcgatcttggctcactacaacctccacctcctgggttcaagcgattcttctgcttcagcctcctgagtagctgggattataggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctcccc

SEQ ID NO: 160166 - DNA, 654 bp, Homo sapiens
  Payload ID: 11328
  Gene Symbol: NPLOC4
  Gene Name: NPL4 homolog, ubiquitin recognition factor
  ENST ID: ENST00000573519
  CDS Start-End: 1-436
gcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcacctcccgagtagctgggattacagatgtgtaccaccacacctggcgttgccatctttatgcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcct

SEQ ID NO: 160167 - DNA, 564 bp, Homo sapiens
  Payload ID: 11328
  Gene Symbol: NPLOC4
  Gene Name: NPL4 homolog, ubiquitin recognition factor
  ENST ID: ENST00000573212
  CDS Start-End: 1-333
actttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaagacagggtttcactctgttgcctaggctggagtgcagtggagtgatcatagctcactacagccttcaattcctgagctcaagcgatcctcctgcatcagctttcggagtacctaggagtataaacatgagccactacacccaactaatgtttttggcacagttggcgggcagctcccaggtctccatgagtacggcgccgtcgggggctccacacacacggccactgcagccatgtgggcctgtcagcactgcacg

SEQ ID NO: 160168 - DNA, 676 bp, Homo sapiens
  Payload ID: 11328
  Gene Symbol: NPLOC4
  Gene Name: NPL4 homolog, ubiquitin recognition factor
  ENST ID: ENST00000571714
  CDS Start-End: 1-549
ggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagttcacgccattctccttcctcagccttcctagtagctgggattacaggtgcgcaccaccacccccaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttcc

SEQ ID NO: 160169 - DNA, 414 bp, Homo sapiens
  Payload ID: 11328
  Gene Symbol: NPLOC4
  Gene Name: NPL4 homolog, ubiquitin recognition factor
  ENST ID: ENST00000570324
  CDS Start-End: 1-176
gcgctcccaacgtggtggaggatgagattgatcagtacctcagcaaacaggacgggaagatttacagaagccgagacccacagctatgccgccacggccctttggggaaatgcgtgcactgcgtccctctagagggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtg

SEQ ID NO: 160170 - DNA, 2365 bp, Homo sapiens
  Payload ID: 11328
  Gene Symbol: NPLOC4
  Gene Name: NPL4 homolog, ubiquitin recognition factor
  ENST ID: ENST00000574897
  CDS Start-End: 150-557
gcggagccgggcgggcgaagctggagcggcggtggcggcggcgtagggaggccggggccggggctgaggccgcggccgggtctgcgaggcccttggggcggcaggcggcggcggcccggggctcgagcccggaggcaggagcagccgccatggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctga

SEQ ID NO: 160171 - DNA, 560 bp, Homo sapiens
  Payload ID: 11328
  Gene Symbol: NPLOC4
  Gene Name: NPL4 homolog, ubiquitin recognition factor
  ENST ID: ENST00000573876
  CDS Start-End: 206-376
gtttattttgtgtctgtattttgtctcaaaaccactcactcgggtatttgacatcaggcaccctgtgcctcttccctgcctgtgccttccctagtcagcccagggaactgcacctcctgctccgaggttcagctgctgcccatctgtctggacaggtggtgaaaggacagcatcagcttgctgctggaggccgtgcggaccagaaatgaggagctcgcccagacatggaagaggtctgagcagtgggccaccatcgagcagctgtgcagcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggc

SEQ ID NO: 160172 - DNA, 946 bp, Homo sapiens
  Payload ID: 11328
  Gene Symbol: NPLOC4
  Gene Name: NPL4 homolog, ubiquitin recognition factor
  ENST ID: ENST00000572760
  CDS Start-End: 256-426
actcactcgggtatttgacatcaggcaccctgtgcctcttccctgcctgtgccttccctagtcagcccagggaactgcacctcctgctccgaggttcagctgctgcccatctgtctggacaggtggtgaaaggtgaggctccctctacaccagagccaccttgctagtatactgcactatttttgcagtcatctgttggaagacattctctggaggacagcatcagcttgctgctggaggccgtgcggaccagaaatgaggagctcgcccagacatggaagaggtctgagcagtgggccaccatcgagcagctgtgcagcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggccgatgctgccaccacccagccttctctttattttcagtgctttttgtttggcctccctgcccccatgtttttctggctgggagctcttggttacccccttgtctgactgcttggtggcaggcaccctgcctgtg

SEQ ID NO: 160173 - DNA, 405 bp, Homo sapiens
  Payload ID: 11328
  Gene Symbol: NPLOC4
  Gene Name: NPL4 homolog, ubiquitin recognition factor
  ENST ID: ENST00000625705
  CDS Start-End: 1-405
atggaagccgtaataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctccattcgatgaggactatctaa

SEQ ID NO: 160174 - DNA, 1700 bp, Homo sapiens
  Payload ID: 11329
  Gene Symbol: NPRL2
  Gene Name: NPR2-like, GATOR1 complex subunit
  Uniprot ID: Q8WTW4
  ENST ID: ENST00000232501
  CDS Start-End: 440-1582
atggaaattgtagttccctgctgcggtcccagttacagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacagc

SEQ ID NO: 160175 - DNA, 1573 bp, Homo sapiens
  Payload ID: 11329
  Gene Symbol: NPRL2
  Gene Name: NPR2-like, GATOR1 complex subunit
  ENST ID: ENST00000433381
  CDS Start-End: 130-393
agagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggtcagaggagaatttgctggggcatttgggagttacctgagggaagctagaccctttatgtctctcaggagccctggatcatggggcactgccaatccaagcaggcttcctggagatgatgggctacagagacaaaattgaagggagactacaggaaagggttggcctgcctgaaagaaggcctggccagggcgtcaccccgtcctctgatcctcaccctaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagtt

SEQ ID NO: 160176 - DNA, 1747 bp, Homo sapiens
  Payload ID: 11329
  Gene Symbol: NPRL2
  Gene Name: NPR2-like, GATOR1 complex subunit
  ENST ID: ENST00000451194
  CDS Start-End: 103-366
agcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagaggtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggtcagaggagaatttgctggggcatttgggagttacctgagggaagctagaccctttatgtctctcaggagccctggatcatggggcactgccaatccaagcaggcttcctggagatgatgggctacagagacaaaattgaagggagactacaggaaagggttggcctgcctgaaagaaggcctggccagggcgtcaccccgtcctctgatcctcaccctaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaac

SEQ ID NO: 160177 - DNA, 939 bp, Homo sapiens
  Payload ID: 11329
  Gene Symbol: NPRL2
  Gene Name: NPR2-like, GATOR1 complex subunit
  ENST ID: ENST00000448302
  CDS Start-End: 130-393
agagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagg

SEQ ID NO: 160178 - DNA, 1030 bp, Homo sapiens
  Payload ID: 11329
  Gene Symbol: NPRL2
  Gene Name: NPR2-like, GATOR1 complex subunit
  ENST ID: ENST00000418825
  CDS Start-End: 130-393
agagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagc

SEQ ID NO: 160179 - DNA, 1364 bp, Homo sapiens
  Payload ID: 11329
  Gene Symbol: NPRL2
  Gene Name: NPR2-like, GATOR1 complex subunit
  ENST ID: ENST00000429366
  CDS Start-End: 53-226
gacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggtcagaggagaatttgctggggcatttgggagttacctgagggaagctagaccctttatgtctctcaggagccctggatcatggggcactgccaatccaagcaggcttcctggagatgatgggctacagagacaaaattgaagggagactacaggaaagggttggcctgcctgaaagaaggcctggccagggcgtcaccccgtcctctgatcctcaccctaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 160180 - DNA, 1006 bp, Homo sapiens
  Payload ID: 11329
  Gene Symbol: NPRL2
  Gene Name: NPR2-like, GATOR1 complex subunit
  ENST ID: ENST00000433999
  CDS Start-End: 94-267
ggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtgtgagaccctagctcgggcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattg

SEQ ID NO: 160181 - DNA, 2784 bp, Homo sapiens
  Payload ID: 11330
  Gene Symbol: NPRL3
  Gene Name: NPR3-like, GATOR1 complex subunit
  ENST ID: ENST00000399953
  CDS Start-End: 246-1880
ccacccctgccctcctcaggccccctccgcctccacccctgccctcctcaggccccctccgcctccacccctgccctcctcaggccccctccgcctccacccctgccctcctcaggccccctgcgtccccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggttttcagatgttattctggcaacaattttggcaaccaagtctgaaatgtgtggccaaaaatttgaactgaagattgataatgtgcgatttgttgggcacccaacactgctacagcatgctctggggcaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaa

SEQ ID NO: 160182 - DNA, 512 bp, Homo sapiens
  Payload ID: 11330
  Gene Symbol: NPRL3
  Gene Name: NPR3-like, GATOR1 complex subunit
  ENST ID: ENST00000422814
  CDS Start-End: 95-304
ctccgcctccggctccgtcctcctcaggccccctccgcctccggctccgtcctcctctggccccctccgcccccggccccggccccacggcgggatgcgggacaacaccagccccatcagcgtgattctggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatgcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgat

SEQ ID NO: 160183 - DNA, 616 bp, Homo sapiens
  Payload ID: 11330
  Gene Symbol: NPRL3
  Gene Name: NPR3-like, GATOR1 complex subunit
  ENST ID: ENST00000419636
  CDS Start-End: 69-616
ggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgat

SEQ ID NO: 160184 - DNA, 794 bp, Homo sapiens
  Payload ID: 11330
  Gene Symbol: NPRL3
  Gene Name: NPR3-like, GATOR1 complex subunit
  ENST ID: ENST00000456528
  CDS Start-End: 104-364
cgccgaagtctcgcgagcccggagcgtggcacgtgggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaaggttttcagatgttattctggcaacaattttggcaaccaagtctgaaatgtgtggccaaaaatttgaactgaagattgataatgtgcgatttgttgggcacccaacactgctacagcatgctctggggcaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacag

SEQ ID NO: 160185 - DNA, 936 bp, Homo sapiens
  Payload ID: 11330
  Gene Symbol: NPRL3
  Gene Name: NPR3-like, GATOR1 complex subunit
  ENST ID: ENST00000457916
  CDS Start-End: 95-271
ctccgcctccggctccgtcctcctcaggccccctccgcctccggctccgtcctcctctggccccctccgcccccggccccggccccacggcgggatgcgggacaacaccagccccatcagcgtgattctggtaagccgcgtagcagatacgctgccagcaacacgggcgaccatgctgatgagcaggacggcgattccaggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcag

SEQ ID NO: 160186 - DNA, 932 bp, Homo sapiens
  Payload ID: 11330
  Gene Symbol: NPRL3
  Gene Name: NPR3-like, GATOR1 complex subunit
  ENST ID: ENST00000483663
  CDS Start-End: 79-267
gtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcag

SEQ ID NO: 160187 - DNA, 922 bp, Homo sapiens
  Payload ID: 11330
  Gene Symbol: NPRL3
  Gene Name: NPR3-like, GATOR1 complex subunit
  ENST ID: ENST00000468260
  CDS Start-End: 318-922
cgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccc

SEQ ID NO: 160188 - DNA, 2812 bp, Homo sapiens
  Payload ID: 11330
  Gene Symbol: NPRL3
  Gene Name: NPR3-like, GATOR1 complex subunit
  ENST ID: ENST00000621703
  CDS Start-End: 404-613
gtctcgcgagcccggagcgtggcacgtgggttggtaactgtggcgctgctccgcgtccaccaccacccctgtcctcctcaggccccctccgcctccacccctgccctcctcaggccccctccgcctccacccctgccctactcaggccccctccgcctccacccctgccctcctcaggccccctccgcctccacccctgccctcctcaggccccctccgcctccacccctgccctcctcaggccccctccgcctccacccctgccctcctcaggccccctgcgtccccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaa

SEQ ID NO: 160189 - DNA, 2981 bp, Homo sapiens
  Payload ID: 11330
  Gene Symbol: NPRL3
  Gene Name: NPR3-like, GATOR1 complex subunit
  ENST ID: ENST00000622194
  CDS Start-End: 83-316
ctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtcccctgtgggacggacag

SEQ ID NO: 160190 - DNA, 2881 bp, Homo sapiens
  Payload ID: 11330
  Gene Symbol: NPRL3
  Gene Name: NPR3-like, GATOR1 complex subunit
  Uniprot ID: Q12980
  ENST ID: ENST00000611875
  CDS Start-End: 287-1996
ttcccatccgcaccagcaagaggggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcgg

SEQ ID NO: 160191 - DNA, 3203 bp, Homo sapiens
  Payload ID: 11330
  Gene Symbol: NPRL3
  Gene Name: NPR3-like, GATOR1 complex subunit
  Uniprot ID: Q12980
  ENST ID: ENST00000620134
  CDS Start-End: 287-1996
ttcccatccgcaccagcaagaggggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcgggtttggaaaggccccttggattcctggctggggacaatgatgacctggaccctggccagaagagccctggccctccagcaaggcagcacctgctctgatgcacctgtgcacccctggccctcccagccacctgggagtccgaagcttagcctggaggtggccaagccagtccctactcttgggctgcggccacgtgaggctccgcatcagcagccaggggcgagcactagtggacaaagccagcaaatgcggcgttcctgtgagcagataccctcaaccagccagctgtcaaaagtatttcaagataaaatccaggccaagc

SEQ ID NO: 160192 - DNA, 14208 bp, Homo sapiens
  Payload ID: 11331
  Gene Symbol: NRDE2
  Gene Name: NRDE-2, necessary for RNA interference, domain containing
  Uniprot ID: Q9H7Z3
  ENST ID: ENST00000354366
  CDS Start-End: 234-3728
ccccttggccccgccccaccctgctttgccctgcctctccctgccccgccgcgccccagtcccttgacgaccctcctctctgggccccgcccctcccgcttcggggtcaagccccagagagcgccgcgaaaaccacatttcccagagtgcaccgcgacggcaggggtcctcagaccggcgctcgctcgccggcgccatccctatagagaagaacggaggtacggcctgtggtcatggcgctgttcccagcctttgcggggcttagtgaggctcccgatggcgggagctccaggaaagagttagactggctgagcaacccaagcttttgtgttggatccataacgtccctgagccaacaaactgaagcagctccagcccatgtttctgaagggttaccgctgacaaggagtcatctgaaatcagagtcttcagatgaaagtgacactaacaaaaagctcaaacaaacaagtagaaaaaagaagaaagagaaaaagaaaaaaaggaagcatcagcatcataagaaaacaaagaggaagcatgggccgtcgagtagcagcaggtctgagacagacaccgattctgaaaaggacaaaccttccagaggcgttggaggcagtaaaaaggaatctgaggaaccgaatcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtgaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatcagactttccagccatgatcttcagttccagctggtggaggccttcctgcagttcttgggtgtgccttctggctttactcctccagcctcctgtctttatctggccatggatgagaacagcatctttgataatggactttatgatgaaaagcccttgacttttttcaaccctttgttttctggggctagctgtgttggccgcatggataggttgggctatcctcgctggaccaggggtcagaaccgagagggcgaggagttcatccgcaatgtcttccaccttgtcatgcctttattttcaggcaaagagaagtcccagctctgcttctcctggttacagtatgagattgcaaaggtcatttggtgcctgcacactaaaaacaagaagagattaaagtctcaagggaagaactgcaaaaaactagccaagaatctccttaaggagccagaaaactgcaacaacttttgcctgtggaagcagtatgcacatctggagtggttgcttggcaacacggaggatgccagaaaagtttttgacacagcacttggcatggcaggaagcagagaactgaaagactctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacgaacaggtgtttgcaaaactgaacagttctgttttcccagaaggctctggcgagggggacagtgccagctcccagagttggaccagtgttctcgaagccatcacactgatgcacacgagcctgctgagattccacatgaaagtgagtgtttacccgctggcccctctgcgagaggcactctcacaggctttaaagttgtatccaggcaaccaggttctttggaggtcctatgtacagattcagaataagtcccacagtgccagcaaaaccaggagattttttgacacaatcaccaggtctgccaaacccttggagccttggttgtttgcaattgaagctgagaaactgaggaagagactggtggaaactgtccagaggttagacggtagagagatccacgccacaattcctgagaccggcttaatgcatcggatccaagccctgtttgaaaatgccatgcgcagcgacagtggcagccagtgccccttgctgtggaggatgtatttgaactttctggtttccttaggaaataaagaaagaagcaaaggtgtattctacaaagcacttcagaattgcccttgggcaaaggtgttgtacctggacgccgtggagtatttccccgatgagatgcaggagatcctggacctgatgactgagaaggagctccgggtgcgcctgccgctggaggagctggagctgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattgaggcgtggcagcgtccttgctcattctctccctgtgcgcagccagcactggcccccgcacggtgaatgtgttccctccgctggtgtcgtggtggtcctgccaggccctctctgagataaaggtctggtttttcagcactaggatgtcttccccaggctggtgagcaggagattttgctcttgtgttgagacccgcagttaacgcttggtgttctggcctgcacgcagtgtgtggcaagttccctgagtttacctcggcggcgatgcctccgcctggagctggaggggcagcgtgccctggggctgctgaaaaactcaggcctgtggagtcagaacccgctcttcagcaggtcccaggccacttgagtgtggaaggctgcccggggcactggcagcctctgggggaagcctgctcccaagccgtctaggagccgagcacgctgtaccgccagccccagccctgcctgcatgaggggcccggcacgcttgtgcagcaacgctgcttacactatgaaggccaaggctggcctggttctggtgttgcattcgagggctgtgaacagaatgaaatgtcaacatccatttttcagacttgttctgcctccgaagagatttttagtgctgagtgattttcactattaacatatggctggaaggaatggttttcttatcttctccgagctctagactggctagcttctctctggctttttttgttttgttttcctctctttagaattgctgtatacttgtatctcctcagcacatttagaaaagccagtgtataattttggctggcaactgacggacgcagcgggcagcagcaggcagggcagcgcacgagagcacctcccagggcacggtgggaaactggccagcccagccccactactgccctctcctgctcgtccccagtccctgagctacaggtggctgtaggcagaagcccaccgggtgttccttagcgacagacaggtcgtcagctgctccccttgatgccttttcacagaaacaaccctcaacttgaggaagttgagagctccactccgaggtggacttgctccccctccctgagagctaactggcttgaactgtcatgagttcctggctgcccacaaagagggaccttctccacccttgtcctctgcgtggggcagacatcagccagacatgtcaccgacctgattgggggcagggagtaggaagtccaggaccaaaccatgctccccatgacagcagctggcgcctcagtccccatctgactcatgtctcttctcatctggttcagaacttagaagggcgtggcctctgatcagctggttccctccaaaccccagtggcaacctgtcccttgagagccaggaatggctcttagcagtgggcagtgagcccccgagaggataaagcggctgctcgaacagattgcgagcacattacttgctgcatgggaggaggtttaaaacaaatcaaagattccttgagggcattttacagaaaacaagatgtcaagagcatcactgttgttatttaaaagcccatttgaggccaggcgcggtggctcacgtctgtaatcccagcactttgggaggccgaggcggacggatcacgaggtcaggagatcgagaccatcctggctaacatggtgaaacccccgtctctactaaaaatacaaaaaattagccgggcgtggtggctggcgcctgtagtcccagctactcggaaggctaaggcaggagaatggcgtgaacctgggaggcagagcttgcagtgagccaagatcgcgccactgcactccagcctgggcgacacagcaagactccgtctcgaaaaaaaaaaaaaaaaaacagcccgtttgagattgctgacatgaacttctgaaagatgactacgtgcctcccaagactaaccgtcagcttggagggctgagaagggggttcccagctggagtcaaacagtggctcatgtgtttcatcaggaacgctcgtcatttccccgaaggagtcactgatcacatcagaccacaggggtcggcccacctcgggtttgggacagtgttctttcctggaatgaagcagtggcaatgcctctggcacaggattgctgggcctgcaggaggccaggaggcacctctgtgctgtgttcccagtaggaggaggcagctactacttgtaaggcacacatatcattttgcattggaaaagtgaagataggcttgctgcagagggagtgatgggagagttcaccttaaattgttctactgaggaagggctccaaagagccagtgggttttccgcaggcagacggggttctccctgtccggctcaccagtgcaggaagccagggaagaaattactgtgggaattctgttatttcacaagcacttcatacctgcatccctgcacttggcaccgcaggcctcagtgaccagctgccgaaacggtaatttcagcattttggtcagtaagcaaactggagaagcagctggggtggggcgcagttcagcccgctaccctgacactctaggccctggcatttgctttagctgcttttgtagaattgacatgagggagactgtccctctagaggaaaacgctcagctattaccaatgaggaaaaggcaatactgatgtgctggggttttttgttttttttaatctcaaacttaggaaaagatgcaagtgcgttacaaagaattttgtttcctgaaccgtgtgagtcagttgctgagagtctgctacccgcccacgatacagacactgaacaggaagtcagcatggacgcagtactcctagcaggtcctcaggcccagtcatgtcctctaggaaaaggatccagttcaggagcaggagctgcacttggttgtcatctctttggtctccttctgattggaagctttttgacttccaagacgtggatacttttgaagtgttctgaatttgtagaatgttcctcagtttgtgtttgcctggtgtttcctcagcactggattcaggctaagcatctttggcaggagtgtgacagcactgacactcttgggtggcacgtactttcaaagtgcccattactgatgatgtgcatttgaccacttggtgaagacggtgtctgctgggcatctccagtgtgactttccctttctaactgaacagtgttttgtggcagactctcaaaatctgtaaataccccttcctcagcaaactttcagatcaattcatatgtattggggtgtgtgtgtgtgtgtgtgtgtgtgtgtgtgtgtgtgtgtgtgtgtgtgtgtagttccctatttaaagggctatactgtattccattaatagtaactgtttgttaggatgctcagattgtcccgagtttggccagtggaagccccttcacataggcttcggtgtccttaggacatgtccttatcattccttgagcactcccttgctttctggcaaaacagactttgggttcatcctgtcctttccctgcctagccccggaatcagccctcactccttttagtggagaataatacttttagcagcaaaggtctgggtctaggggtgctcactgcagttggggtgtcactgttcccaggtgctcccagtggacagaggtcgttcttgttttcttctttctgtgtctaactcctcagagaaacctggctcccactgtcctgtttacctgcctgactgcctccatacataagcagcctccctcccctgccaccaccccgtccctgcagatgccttcctcacccacttgggctctcatactgcacatcaggctgcccacactgactccccctatcggaccaccccagccctgcacatacaccccacacggatgccagcctcaccctgcccatgctgagtccccgtgctgtggtgttcctccacatggacagctccacaccctacttgggctgacacccgccctccccacaagcaccccgtccttaccctgcactgggccacccccacgtgtggatgtcctctgtggtaggcagagtggcgcccctaaagatggccacaccctaagccctggaacgtgtgaatgttacatggcaaaaggaactttgcagataaaaattaagaagattgtaaactttaaaacagggaaattatcctggatcatctgcatgggtccaatgcaatcacaaggatccataagaatagaaaaggcaggcagaaagaagggtcggtgggagagagggactgggcctgctgctgctggtggaaaatgaagtgccacgagtcaggagggagggtggccttcacagactggcaaaggcctcagctggcagccagcaaggaaatgctgacctcagctggcccacaactccaagaaattaaattctgccaacaataatcctcagcaaggaaacggattctcccttagagacgccagagggaacggtcctgccaacagcaagactttagcctggagacactcgtgttggacttctgacctacagaactgagataaaattgtggtttttatttatttatttatttatttttgagacggagtcttgctctgtcgcccaggctggagtgcagtgacgggatcttggctcactgcaacctccgcctcctgggttcaagcgattgtcctgcctcagcctcctgagtagctgggactacaggcacctgccaccacgcacagctaatttttgtatttttagtaaagatggggtttcaccatgttggccaggctggcctcaaacttctgaccttgtgatccgcctgcctcagcttcccaaagtgctgggattacaggcgtgagccaccgtgcctggccaaattgtgctgtttttaaacaaagcctgtggtaacttgttatagtattaacagaaaactaatacacactcctcattcagtgtgggccctacaacccacaccaggccacctgtcaagggaacgcttaccttgatctgtcccacttaatagctttaggcctgatttgttcagaaagagaaatgacggaaatagacggagaaagggaaggggaagttctgacatgtttctgaacaccttgaaagggatgagatttctgagcccaagggctcagaagggctttcaagatatctctaggaatcctcagtctcttgggaacaccagtagttattttctgccctcagagtgctaagaacatgcatggtccacaaaacttccaaaaaggaaagctgtacttcctttggaagcaatagccacattaacgcagcctttattatttaaacaacgaatatccctggctctgtggtagtgaccatttcccactgtaattaccgttgaacgccagctctgggggtgtgatgtggcgaacgcatagtgaggtccacactccttgggaccgcagcctgagttcctgtccaaaggcttccctgtagctgggtccacccacaggctgctgttgagcggtaggtgtgtgtggagactgcagaaacaggaagtgtttgtgaaagagcacgctttattgggaagcagactgctgcacagtgaccaacaggccacccaatgggcacttacacatcgtactccaaaagacacaggatgttttgctaataaaaatcagtgggaacagggattcctctgggcaactcccccaacctcatccctttcagggattgagaaatctcccaaccattttcctgatgacagccatggttcattagagatacagcccctcaggggtgccttcctgtttcttataaagaacattttctttagattttttgaagtcttcatttgttactttcattctacgttctcttaaggccatcagaccagcttctgtacagattgcctgtaagaaagaagagtgtgttcagaaagtgacatactcatttttattctaacaaggaattccaaaaaacctattctgaggccaggcgcggtggctcacacctgtaatcccagcactctgggaggccgaggcaggtggatcgcctaaggtcaggagttcaagaccagcctggccaacacggtgaaaccccatctctactaaaaatacaaaaagttagccagggacggtggcaggcacctgtaatcctagctactcgggaggctgaggcaggagaattgcttgaacccgggaggcagaggttacagtgagccgagatcgcgccactgcactctagcctgagcaacgagcgaaactctacctcaaaaaaaaaaaaaaaaaaatctgttctgaaataaagcatgagacacctagactaaacacaaattgcttatttgggaaagatttgatttttaaaaaaaatgttttaagcatcctattttctgaaaggatgtgaagtggcttaaactgggagttactgtaactaagactgacccaagggtcagggctgtgggttctagttttggctcaggttctaacaagctatgtggcttgtacaacaccacttttgttaaagagaataatattcctaggaaataaacaaaattatgccctgaaacttagaggcaattgacagtatatgtctatttcatttacttatagtcataaaagaacatgtattctggttagatactgtaagtggcagtatctatactatggaataatactacagagtatagcatttattccaatatatttaatttctcagtaattactggcccaaagtaaaagaaaacaataacccatgttacatgggttactgttattgttttaggcctgatctgtttagaaaggaaagagaaatgaaggaaatagatagagaaggacagcaaacaaacatattatgtgggttactgttattgttttctttttcttttggccagtaattactgtggcaaaaacaagatgtggcaaaaaacacaatcctggcacagaagtttgtttggtgatggccatcaggttatttacttcaaatggttcgggtgaaaagaaagttttgtgtatagaaagagaaaaagcaaacaggtaaaatgttaactcttggcaaatcactgtgctattgttgcaacttttttgaaggcttgaaaattgtcaaagtaagttcttatcttaaaattttaagatctttcaatttttaaaaaagaagatagattttacttgccaacagagacatctagttctctaggactaactgccaatgatccgtgggctcagggcaggtgctggcctggaaaggcactgcttgtgctgtccctacctaaccatggcatttatgcccaacgaaaacccagctctttccaggaaaagcaggtagaacccatattcaacgctgccagaccttgctgtaaattctggtcagctgggaggaaatgtcctaactcatgtacatttgtcataaaaccaagaagtataatctggtacaaccttccagaacacagattgggagatgaatgcagcgggtgcttggtccccactctgcggctctggggagagttctcccaggacatacccttcccctgacctgggactgagcagctacatttgacacaccttgagaaagtcacctgggcctaaggcttagtaccagcgactcagccttgtggctccaggtgatttagcgtcattcactgcataaaatgatgcattaagaatgacttcaatatcaagcacatataccatttggatgtaatcgtaaaccaatatgatgattaaaatacagacacccacctgtccaggccaaccaccatcccaagagcacatatagactctttcctgattgacggccacattcccagaaataagctgacacggctaggctctcaccttgatgtcagcaccagagaggtcatctttagccatgatcaggtcgtccagggttacatcatcagccagcgtcatcctgcttgtgtgaatctgaaagatgcgcttcttcgtcttttcatcaggcagggggaactcaatcttcctgtcaatgcggcctgcaggtacaaagagatttgaagtcacaccaacatccaaacccaggctcggccatggctcagaggcctcagcccatctccttacatacgaagtttcagtcggacagaattctgtgggaaggatgtctaaattttaaaaagtaaacatatatttttgtagtttgtagatttctacatttgaattctcttcatttaaaagaaactctctctgctttggtaccttcagaaataaatgaaaggagcaattcctgagtgaaactgggcagacctattgtgttaaaaacattacaaaagacagcaaacaaatcactgtttcttctgatgctacctgaatgtaaaaaggacaaatcctaccatcacatgaattatttcttccagaaaaagcagcaagttcttgaggctaaaaagggaatgttatggaaaagaaaagacaagacataagactggaattcaaagggccaaggtgcacagaccatatcatgctctgttttaaccctcatctcaagaggacctatttttttgtaaattatcctaagtttcactgcagtatttgcttttttatgtatcattttataggcctcccaaagcacacttaaacacaaatatataaacacattaatctccatgatgaaaccaaagcaaatttaacctggtctgataagtgctggatccaaagtttctattcggtttgtggccatgataactttcacatctcccctagaatcaaatccatccaactggttcagcagttccaacattgttcgctgaatttctctctcaccaccagaattggagtcatatctttggaaaaaaaaaaagggaaggaatgaagactcaactgatcgcctgctcaaggggaattacagcaaagacctcattgtgacaaaacaccttaacaaacattcctgtttcaactcacatggcactccctcaattatgctcggaaaaaataaattcagcaccccttgccatggtctgaatgtatttccccaaatttatgtgttgaaacttaatccctactgtgtggctaagagatgaggccttttggaaagggctaaaggcatgaggcagagccttatacagcatgagttccttctaaaaagagaaaaaggccttatacagcatgtattccttataaaaaatgctgcagggaactagtgtaggccctttttgctcttttgtttgtcccctgagcatttgtctcctctgcagaataggtgccatctcggaagcagagagcagccctcactagacatcaatgccagtgccttgatcttgggcttctcagcctccagaactgtgggaaatacatttctattctttatacaaataccagtcctaaggtattttgtttagcagcacaaatggactaagacgctcccatcagccaagttacagatcatattttttcatagcagtttctgtgtctgaaattgtatcatttattctgtttccatgtttggtatctgatccctacaacctgtgagctcctccagggcagagacttgtgctcacaactgtgtccctagagtccagatggtcctggatcagggcgggtgctcaagacatggttattcataactgaccaatctctccagacgttcacagttactgggcagttgttagctggctcctgggagagcagagcctaaagcatgcatggaaggccacgcacagcaagaactgtggccatagggagagccccctgagattgctcattctcaagagaagagctatgcggtgttccctactaaacaaggcaaaataagtatgagaaagtctacctttttgtcccaatggcgtcaatttcatcaataaacacgatggacggtgcatgttcttcagcaactcggaacaattcccgtacgagtttgggcccatcacctaggtacttctgaataagttcagagccaaccactctcaagaaagtggctgaggtttggtttgctactgctttggctaacaaggttttacctattttggatgaaaaagataaaaaaaaaaaagacaccttaagtgccattttaacttaaaaactcgtatcattaccaccttaaatggacaccaaaaacaggcgggccctcatgctaaggcatggcaccaattcaagtgtcacgacattccattctcctaagtagataagaggacatttagaaaaatctactaacatgtttggattatccttagctattttgctgaacttatgataacgtcagaaaatactttttacttggttattttccaaccttgacccagtttcccctgaaaagctgcgaactataattacctgtacgaagaattgcttcattccagtaatgaaataaatctcatttttttctctg

SEQ ID NO: 160193 - DNA, 3434 bp, Homo sapiens
  Payload ID: 11331
  Gene Symbol: NRDE2
  Gene Name: NRDE-2, necessary for RNA interference, domain containing
  ENST ID: ENST00000553409
  CDS Start-End: 7-138
gtggtcatggcgctgttcccagcctttgcggggcttagtgaggctcccgatggcgggagctccaggaaagtcaaggaaataatgctgcagctgatactggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcaggacgaggtcatgaaaagtcctggcctgtatgccatcgaggaaggagagcaggaaaagcgaaagaggtccctgaagctcattctggagaagaagctggccattctggagcgggccattgagagcaaccagagcagtgtggatctgaaactggccaagctgaagctctgcacagagttctgggagccctccactctggtcaaagagtggcagaaactgatatttttgcatcccaataatacagccctttggcagaaataccttttattttgccagagccagtttagtaccttttcgatatcaaaaattcacagtctttatggaaaatgcttgagcactttgtctgctgttaaggacggcagcatcttatctcaccctgcgttgcctggcacggaagaggccatgtttgcactctttcttcagcagtgccactttctgcggcaggctggccactctgagaaggccatctcattgttccaggccatggtggacttcaccttcttcaaacccgacagcgtgaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatcagactttccagccatgatcttcagttccagctggtggaggccttcctgcagttcttgggtgtgccttctggctttactcctccagcctcctgtctttatctggccatggatgagaacagcatctttgataatggactttatgatgaaaagcccttgacttttttcaaccctttgttttctggggctagctgtgttggccgcatggataggttgggctatcctcgctggaccaggggtcagaaccgagagggcgaggagttcatccgcaatgtcttccaccttgtcatgcctttattttcaggcaaagagaagtcccagctctgcttctcctggttacagtatgagattgcaaaggtcatttggtgcctgcacactaaaaacaagaagagattaaagtctcaagggaagaactgcaaaaaactagccaagaatctccttaaggagccagaaaactgcaacaacttttgcctgtggaagcagtatgcacatctggagtggttgcttggcaacacggaggatgccagaaaagtttttgacacagcacttggcatggcaggaagcagagaactgaaagactctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacgaacaggtgtttgcaaaactgaacagttctgttttcccagaaggctctggcgagggggacagtgccagctcccagagttggaccagtgttctcgaagccatcacactgatgcacacgagcctgctgagattccacatgaaagtgagtgtttacccgctggcccctctgcgagaggcactctcacaggctttaaagttgtatccaggcaaccaggttctttggaggtcctatgtacagattcagaataagtcccacagtgccagcaaaaccaggagattttttgacacaatcaccaggtctgccaaacccttggagccttggttgtttgcaattgaagctgagaaactgaggaagagactggtggaaactgtccagaggttagacggtagagagatccacgccacaattcctgagaccggcttaatgcatcggatccaagccctgtttgaaaatgccatgcgcagcgacagtggcagccagtgccccttgctgtggaggatgtatttgaactttctggtttccttaggaaataaagaaagaagcaaaggtgtattctacaaagcacttcagaattgcccttgggcaaaggtgttgtacctggacgccgtggagtatttccccgatgagatgcaggagatcctggacctgatgactgagaaggagctccgggtgcgcctgccgctggaggagctggagctgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattga

SEQ ID NO: 160194 - DNA, 612 bp, Homo sapiens
  Payload ID: 11331
  Gene Symbol: NRDE2
  Gene Name: NRDE-2, necessary for RNA interference, domain containing
  ENST ID: ENST00000554464
  CDS Start-End: 1-612
ttttcgatatcaaaaattcacagtctttatggaaaatgcttgagcactttgtctgctgttaaggacggcagcatcttatctcaccctgcgttgcctggcacggaagaggccatgtttgccgactctgaacataggatgaaagttgctgcactctttcttcagcagtgccactttctgcggcaggctggccactctgagaaggccatctcattgttccaggccatggtggacttcaccttcttcaaacccgacagcgtgaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatc

SEQ ID NO: 160195 - DNA, 2937 bp, Homo sapiens
  Payload ID: 11331
  Gene Symbol: NRDE2
  Gene Name: NRDE-2, necessary for RNA interference, domain containing
  ENST ID: ENST00000556189
  CDS Start-End: 1-682
tggacatcgctttgtttggcttgaggacattcaggctgtgacgggagaaaccttcagaacagataagaaaccagatcctgcgaactgggagtacaagtctctctaccgaggggatatagcaagatacaagaggaaaggagactcctgccttggcattaaccctaagaagcagtgcatatcttgggaagggacttccacagagaagaagcattcacgcaagcaggttgaacgctattttactaagaagagtgtgggattaatgaacatcgatggagttgccattagcagtaaaactgaacctccctcatctgagcccatctcctttataccagtgaaggacttggaagatgcggctcctgttacaacctggttgaatcctctggggatttatgatcagtcaaccacacattggctacaaggacagggtcctccagagcaggaatcaaagcagccagacgcacagccagacagcgagagtgcggctctcaaggccaaggtggaggagtttaacaggagggtgcgggagaatcctcgggatacgcagctgtggatggcatttgttgcttttcagcactctttcttcagcagtgccactttctgcggcaggctggccactctgagaaggccatctcattgttccaggccatggtggacttcaccttcttcaaacccgacagcgtgaaagatctgcctaccaaaggacaggtggaattctttgaacccttttgggacagtggagagccccgggctggggagaagggagcccgaggctggaaggcgtggatgcaccagcaggaacgaggtggctgggtggtcatcaacccagatgaggatgacgatgaaccagaagaggatgaccaggaaataaaagataagactctgcccaggtggcagatctggcttgctgctgagcgttcccgtgaccagaggcactggcggccctggcgccctgataagaccaagaagcaaaccgaggaagactgtgaggatcccgagagacaggtgttgtttgatgatattgggcaatctttgatcagactttccagccatgatcttcagttccagctggtggaggccttcctgcagttcttgggtgtgccttctggctttactcctccagcctcctgtctttatctggccatggatgagaacagcatctttgataatggactttatgatgaaaagcccttgacttttttcaaccctttgttttctggggctagctgtgttggccgcatggataggttgggctatcctcgctggaccaggggtcagaaccgagagggcgaggagttcatccgcaatgtcttccaccttgtcatgcctttattttcaggcaaagagaagtcccagctctgcttctcctggttacagtatgagattgcaaaggtcatttggtgcctgcacactaaaaacaagaagagattaaagtctcaagggaagaactgcaaaaaactagccaagaatctccttaaggagccagaaaactgcaacaacttttgcctgtggaagcagtatgcacatctggagtggttgcttggcaacacggaggatgccagaaaagtttttgacacagcacttggcatggcaggaagcagagaactgaaagactctgacctctgtgagctcagtctgctctatgctgagctggaggtggagctgtcgccagaagtgagaagggctgccacagctcgagctgttcacatattaaccaagctgactgagagcagcccctatgggccctacactggacaggtgttggctgttcacattttgaaagcgcgaaaggcttatgagcacgcactgcaggactgtttgggtgacagctgtgtctccaatccagctcccaccgattcctgtagccgcctaattagcctggctaaatgcttcatgctcttccagtatttgaccatagggattgatgctgctgtgcagatatacgaacaggtgtttgcaaaactgaacagttctgttttcccagaaggctctggcgagggggacagtgccagctcccagagttggaccagtgttctcgaagccatcacactgatgcacacgagcctgctgagattccacatgaaagtgagtgtttacccgctggcccctctgcgagaggcactctcacaggctttaaagttgtatccaggcaaccaggttctttggaggtcctatgtacagattcagaataagtcccacagtgccagcaaaaccaggagattttttgacacaatcaccaggtctgccaaacccttggagccttggttgtttgcaattgaagctgagaaactgaggaagagactggtggaaactgtccagaggttagacggtagagagatccacgccacaattcctgagaccggcttaatgcatcggatccaagccctgtttgaaaatgccatgcgcagcgacagtggcagccagtgccccttgctgtggaggatgtatttgaactttctggtttccttaggaaataaagaaagaagcaaaggtgtattctacaaagcacttcagaattgcccttgggcaaaggtgttgtacctggacgccgtggagtatttccccgatgagatgcaggagatcctggacctgatgactgagaaggagctccgggtgcgcctgccgctggaggagctggagctgctgctggaggattagagagcagcgggaaaacgggctgtgcctgcgaggccaagttgcccaccctgcggagctaggaggcgcgagcagagaacgtgtgtgttaggagaactcggcttttgaaatgttctttctcgatagtaataatgtgggctgccagcctctcacatcttgcacactttttgggtgtgtaaatgacacaaaagttatttacatattatatatgtgaatatgtgtatatatgtacatagccagagagtcatgccacgtggtcattaaaccgatgatgattgaggcgtg

SEQ ID NO: 160196 - DNA, 132 bp, Homo sapiens
  Payload ID: 11331
  Gene Symbol: NRDE2
  Gene Name: NRDE-2, necessary for RNA interference, domain containing
  ENST ID: ENST00000628832
  CDS Start-End: 1-132
atggcgctgttcccagcctttgcggggcttagtgaggctcccgatggcgggagctccaggaaagtcaaggaaataatgctgcagctgatactggacatcgctttgtttggcttgaggacattcaggctgtga

SEQ ID NO: 160197 - DNA, 1199 bp, Homo sapiens
  Payload ID: 11332
  Gene Symbol: NSA2
  Gene Name: NSA2 ribosome biogenesis homolog
  ENST ID: ENST00000296802
  CDS Start-End: 371-940
aggaggcgcgagccgcgccaaagtctgcaacggcctcaagtctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatc

SEQ ID NO: 160198 - DNA, 448 bp, Homo sapiens
  Payload ID: 11332
  Gene Symbol: NSA2
  Gene Name: NSA2 ribosome biogenesis homolog
  ENST ID: ENST00000515524
  CDS Start-End: 1-295
cagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaa

SEQ ID NO: 160199 - DNA, 4594 bp, Homo sapiens
  Payload ID: 11332
  Gene Symbol: NSA2
  Gene Name: NSA2 ribosome biogenesis homolog
  Uniprot ID: O95478
  ENST ID: ENST00000610426
  CDS Start-End: 370-1152
ggaggcgcgagccgcgccaaagtctgcaacggcctcaagtctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacctgacatcagcttactatagactgaatacactttcaacatcagtccttagctacctcaaataatgacacaaagtcttagtttcttttgcataaggatcaagatcaagctatttttaaaacaatttaaatggtctcaaaacattctccaacttaagtgcaaatttgagtacacataatatttccaaagagtagaactgtttttagattatctttggattctaataaccattttgtccatttttaaataaattacaaaaaataaca

SEQ ID NO: 160200 - DNA, 1067 bp, Homo sapiens
  Payload ID: 11333
  Gene Symbol: NSMCE1
  Gene Name: NSE1 homolog, SMC5-SMC6 complex component
  Uniprot ID: Q8WV22
  ENST ID: ENST00000361439
  CDS Start-End: 101-901
gcgttcgcgttcgccccgcctcaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcagcc

SEQ ID NO: 160201 - DNA, 472 bp, Homo sapiens
  Payload ID: 11333
  Gene Symbol: NSMCE1
  Gene Name: NSE1 homolog, SMC5-SMC6 complex component
  ENST ID: ENST00000567710
  CDS Start-End: 252-472
gcggcctgggatgcgcttgggctccctggtgaaaaagcaaaatataaaattcgattcaaactgtgattacatctatggaaaatacagcctttgccgaccaccctctttgtcccgccgccctccgtgctcccctctgttttgtgtacggagtttcttactttgtacaagtccgcagccgcttatgttacagccccgaggccagatgcgtttaaaatcgaggagttctcggagtttggaaagttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagagg

SEQ ID NO: 160202 - DNA, 878 bp, Homo sapiens
  Payload ID: 11333
  Gene Symbol: NSMCE1
  Gene Name: NSE1 homolog, SMC5-SMC6 complex component
  ENST ID: ENST00000566087
  CDS Start-End: 67-279
gtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgtatgtccttcatctctctgacctctgagaaagagaagcagcgatcctttctggctcgcctctgcattggttgctgagggtctgctgagagcccagggtctgctctcttgggccagctccactcctgcacccccgtctcatccagggcctgccctgccctgtcctcagtgctgtgctagcaggaccgcccgtccaccctgtctgtcgggagggctgtcagagggcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcc

SEQ ID NO: 160203 - DNA, 1782 bp, Homo sapiens
  Payload ID: 11333
  Gene Symbol: NSMCE1
  Gene Name: NSE1 homolog, SMC5-SMC6 complex component
  ENST ID: ENST00000569236
  CDS Start-End: 283-495
aagagtccaccttgcgaccgtatccgctagcgcggcctgggatgcgcttgggctccctggtgaaaaagcaaaatataaaattcgattcaaactgtgattacatctatggaaaatacagcctttgccgaccaccctctttgtcccgccgccctccgtgctcccctctgttttgtgtacggagtttcttactttgtacaagtccgcagccgcttatgttacagccccgaggccagatgcgtttaaaatcgaggagttctcggagtttggaaagttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgtatgtccttcatctctctgacctctgagaaagagaagcagcgatcctttctggctcgcctctgcattggttgctgagggtctgctgagaggtgaggagcggcgctgcagcgtgtagtgaatgagctggtgcaccgatggagaggacggttcgtcactaagtgatctaccacagaccagccactctccttccacccggctcttcccagcattgttcactggccatgcttggaagtgcccatggcagttctcatctttgcatctgtgtgcctgaaggtccagagaatctttttccccaggcggttgggggaaagatgagagctacaggctgagaggtgaaatcctgtggcccctcacaaacctccccagccccgtgtcctgcccaccagcccttccttcttcccagcccagggtctgctctcttgggccagctccactcctgcacccccgtctcatccagggcctgccctgccctgtcctcagtgctgtgctagcaggaccgcccgtccaccctgtctgtcgggagggctgtcagagggcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgc

SEQ ID NO: 160204 - DNA, 625 bp, Homo sapiens
  Payload ID: 11333
  Gene Symbol: NSMCE1
  Gene Name: NSE1 homolog, SMC5-SMC6 complex component
  ENST ID: ENST00000564342
  CDS Start-End: 192-625
ggctgtggaactcggggactggggtcttggggtttcccccttcttgatggggaaactgaggcccagacaggggccgcagaaaacagcggactgggatgtcctcccgcaacacacacgcagacatctaaaaatcttactatttagtgaaaaatatttttaatcgtaattacgatttaacagttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaagga

SEQ ID NO: 160205 - DNA, 493 bp, Homo sapiens
  Payload ID: 11333
  Gene Symbol: NSMCE1
  Gene Name: NSE1 homolog, SMC5-SMC6 complex component
  ENST ID: ENST00000563900
  CDS Start-End: 80-493
aggaaactaacatttattaagtgtttactagtagttctctcagtaatgaacttcattataattttatgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggc

SEQ ID NO: 160206 - DNA, 260 bp, Homo sapiens
  Payload ID: 11333
  Gene Symbol: NSMCE1
  Gene Name: NSE1 homolog, SMC5-SMC6 complex component
  ENST ID: ENST00000562039
  CDS Start-End: 1-237
cttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagaagtcttcgaccctgagaaggagagggagtctggtgtcttgaaatcgaacaaaaagtccctgcgg

SEQ ID NO: 160207 - DNA, 626 bp, Homo sapiens
  Payload ID: 11333
  Gene Symbol: NSMCE1
  Gene Name: NSE1 homolog, SMC5-SMC6 complex component
  ENST ID: ENST00000563273
  CDS Start-End: 47-626
cgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgaggaaggggagttcaccctgcacggccgggccatcctggagatggagcaatacatccgggagacgtaccccgacgcggtgaagatctgcaatatctgtc

SEQ ID NO: 160208 - DNA, 1195 bp, Homo sapiens
  Payload ID: 11334
  Gene Symbol: NSMCE2
  Gene Name: NSE2/MMS21 homolog, SMC5-SMC6 complex SUMO ligase
  Uniprot ID: Q96MF7
  ENST ID: ENST00000287437
  CDS Start-End: 217-960
gcccgctctcacttttcagcggcaggcgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgca

SEQ ID NO: 160209 - DNA, 996 bp, Homo sapiens
  Payload ID: 11334
  Gene Symbol: NSMCE2
  Gene Name: NSE2/MMS21 homolog, SMC5-SMC6 complex SUMO ligase
  ENST ID: ENST00000517315
  CDS Start-End: 200-763
taatatgtggtcttttgtgactggctgttttcttagcataaggttttcaaggttcatccatgttgcatgtatcagtgagagaggtggatgctttggagcttttggctcagaaatgataatgtacataacacaggcagccatgagttaaaatgcaagttctgctatctgctagctctctgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctg

SEQ ID NO: 160210 - DNA, 664 bp, Homo sapiens
  Payload ID: 11334
  Gene Symbol: NSMCE2
  Gene Name: NSE2/MMS21 homolog, SMC5-SMC6 complex SUMO ligase
  ENST ID: ENST00000519712
  CDS Start-End: 1-285
ggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatctaggtgtggtggcgcacgcctgtagttccagctacttgggaggctgaagtgggaggatcacttgagcccaggagttcaagatcagcctggacaacatagtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtaagtcaacatgctttgctttggttcggctttttgaaattagggaactgacttgatgaacagccccagttaactgattttataaagtttgcttatctgcttggcttgatcctcattctaagttgcgttttattgttgttgcaattctgtattttgtctaatttttggttcaaa

SEQ ID NO: 160211 - DNA, 787 bp, Homo sapiens
  Payload ID: 11334
  Gene Symbol: NSMCE2
  Gene Name: NSE2/MMS21 homolog, SMC5-SMC6 complex SUMO ligase
  ENST ID: ENST00000523741
  CDS Start-End: 370-787
agtttccacccctccctcaaggcggcggtcctcttctatccgcagtcccggacctggagcgggtcagaccccgacttccgcccctgactccccaggcggtcacatgaccgaagcggctgggagcagggaggggcatcatgtgaccactcgccggcgacggctgatgacgcaagagcccgctctcacttttcagcggcaggcgaagggggctgaggaaaggaggcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaat

SEQ ID NO: 160212 - DNA, 841 bp, Homo sapiens
  Payload ID: 11334
  Gene Symbol: NSMCE2
  Gene Name: NSE2/MMS21 homolog, SMC5-SMC6 complex SUMO ligase
  ENST ID: ENST00000517532
  CDS Start-End: 263-841
gacgcaagagcccgctctcacttttcagcggcaggcgaagggggctgaggaaaggaggtgggtctaggcaggggaaattggggtgccaccagacggagacagcttggactaccaggcttttaagaactgtgctattgttgacttcttcacagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgcc

SEQ ID NO: 160213 - DNA, 765 bp, Homo sapiens
  Payload ID: 11334
  Gene Symbol: NSMCE2
  Gene Name: NSE2/MMS21 homolog, SMC5-SMC6 complex SUMO ligase
  ENST ID: ENST00000518146
  CDS Start-End: 191-433
cgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagagtttttgggaagaagagcacagaggtcaagggcccttctcatcacgtcatatcaaagctagtgcaagtcatcaacatgaccagtaatgtcaaccttgatcacctggccctagtagtgtttgtcaagtttctttactggaaagctgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtaagtcaacatgct

SEQ ID NO: 160214 - DNA, 1037 bp, Homo sapiens
  Payload ID: 11334
  Gene Symbol: NSMCE2
  Gene Name: NSE2/MMS21 homolog, SMC5-SMC6 complex SUMO ligase
  Uniprot ID: Q96MF7
  ENST ID: ENST00000522563
  CDS Start-End: 104-847
agcggcaggcgaagggggctgaggaaaggaggtgggtctaggcaggggaaattggggtgccaccagacggagacagcttggactaccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgttta

SEQ ID NO: 160215 - DNA, 405 bp, Homo sapiens
  Payload ID: 11334
  Gene Symbol: NSMCE2
  Gene Name: NSE2/MMS21 homolog, SMC5-SMC6 complex SUMO ligase
  ENST ID: ENST00000518013
  CDS Start-End: 272-405
cttttcagcggcaggcgaagggggctgaggaaaggaggtgggtctaggcaggggaaattggggtgccaccagacggagacagcttggactaccagaattacagaagagcatgatcgtgttttccttggtcctctgcaaaagtgaagtttcactaaagtaataatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgc

SEQ ID NO: 160216 - DNA, 1183 bp, Homo sapiens
  Payload ID: 11334
  Gene Symbol: NSMCE2
  Gene Name: NSE2/MMS21 homolog, SMC5-SMC6 complex SUMO ligase
  ENST ID: ENST00000520866
  CDS Start-End: 226-699
gacgcaagagcccgctctcacttttcagcggcaggcgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtaagtcaacatgctttgctttggttcggctttttgaaattagggaactgacttgatgaacagccccagttaactgattttataaagtttgcttatctgcttggcttgatcctcattctaagttgcgttttattgttgttgcaattctgtattttgtctaatttttggttcaaatcagcctgctcatttctgaaagccaacagtttccacaaagtgctcagaaaatttcccagcagctagttatgtgtattgtcccattgctggggagggaaattgggaaaacaaaataaaagtgaaaactattttatttaaataacaatggtatcgttcaagttttaaactgctgtgccatgctttaaaataaccatactttgattctggttttgcctctttggagtaatattagctatgttttctctcagaagaccactttatcttctcaactatagaccaaaatctccttgatccattttagcattgtggtagtataaattccatgtggtttttaaattgttgccttcttaataaactattacattc

SEQ ID NO: 160217 - DNA, 848 bp, Homo sapiens
  Payload ID: 11334
  Gene Symbol: NSMCE2
  Gene Name: NSE2/MMS21 homolog, SMC5-SMC6 complex SUMO ligase
  ENST ID: ENST00000519010
  CDS Start-End: 168-641
gacgcaagagcccgctctcacttttcagcggcaggcgaagggggctgaggaaaggagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtaagtcaacatgctttgctttggttcggctttttgaaattagggaactgacttgatgaacagccccagttaactgattttataaagtttgcttatctgcttggcttgatcctcattctaagttgcgttttattgttgttgcaattctgtattttgtctaatttttggttcaaatcagcctgctcatttctgaaagccaacagtttccacaaagtgctcagaaaatttcccagcagctagttatgtgtattgtcccattgctg

SEQ ID NO: 160218 - DNA, 1224 bp, Homo sapiens
  Payload ID: 11335
  Gene Symbol: NSMCE4A
  Gene Name: NSE4 homolog A, SMC5-SMC6 complex component
  Uniprot ID: Q9NXX6
  ENST ID: ENST00000369017
  CDS Start-End: 30-980
gttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcgagacagtctcactctttcgcccagactggaatgcagtggcaccatctcaactcactgcaacctccacctcctggattcaagcaattctcctgcctcagcctcctgagtagctgggattacaggcgcacgcgccaccacatctggctaattttttttctgtatttttagtagagacattgtttcgccatgttggccaagctagtcttgaacccctgacctcaggtgatctgccagcatcggcctcccaaagtgctgggattacaggtgtgagtgccatgcccagctggatgattaagttctttatagcattttactcttgtataaattgctgaagtaaaaaatcttagtat

SEQ ID NO: 160219 - DNA, 1394 bp, Homo sapiens
  Payload ID: 11335
  Gene Symbol: NSMCE4A
  Gene Name: NSE4 homolog A, SMC5-SMC6 complex component
  Uniprot ID: Q9NXX6
  ENST ID: ENST00000369023
  CDS Start-End: 53-1210
agtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggggacgagatgatggacccggccagcttggaggcggaggccgaccaaggcctgtgccgccagatccgccatcagtaccgggcgctcatcaactccgtccaacaaaaccgtgaggacatactgaatgccggtgacaaattaacagaggtccttgaagaggctaacactctgtttaatgaagtgtcccgagcaagagaagcagtcctggatgcccactttcttgttttggcttcagatttgggcaaagagaaagcaaagcagctgcgctcagacctgagctcctttgacatgttaagatatgttgaaactctactcacacatatgggtgtaaatccgctagaagctgaagaactcatccgtgatgaagatagtcctgattttgaattcatagtctatgactcctggaagataacaggcagaacagcagaaaacacctttaataaaacccatacattccactttctgttgggttcaatatacggagagtgccctgtgccaaagccacgagttgatcgtccaagaaaagttcctgtgatacaagaggagagggcaatgcctgcccagttaagaagaatggaagaatctcatcaagaagcaacagagaaagaagtagaaagaatcttgggattgttgcagacatattttcgagaagatcctgataccccaatgtccttctttgactttgtggttgatcctcattctttcccccgtacagtggaaaacatctttcatgtttccttcattatacgggatggttttgcaagaataagacttgaccaagaccgactgccagtaatagagcctgttagtattaatgaagaaaatgagggatttgaacataacacacaagttagaaatcaaggaattatagctttgagttaccgtgactgggaggagattgtgaagacctttgagatttcagagcctgtgattactccaagtcagaggcagcagaagccaagtgcttgatgctagctgaaggactcaaatggatagtgaagtccaaaacggaaagcggcatgtatcgtacatattgtatgattcaacatttttaaaggcagattgtttttagtaaaatgtagcttttgatagttaataaatttgtcatggttgtctttgattaaaggaaactcaccgccatattcacaaataa

SEQ ID NO: 160220 - DNA, 3568 bp, Homo sapiens
  Payload ID: 11336
  Gene Symbol: NSFL1C
  Gene Name: NSFL1 (p97) cofactor (p47)
  Uniprot ID: Q9UNZ2
  ENST ID: ENST00000216879
  CDS Start-End: 869-1981
aagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttgatgagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaatgga

SEQ ID NO: 160221 - DNA, 2611 bp, Homo sapiens
  Payload ID: 11336
  Gene Symbol: NSFL1C
  Gene Name: NSFL1 (p97) cofactor (p47)
  Uniprot ID: Q9UNZ2
  ENST ID: ENST00000353088
  CDS Start-End: 5-1024
gaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagagttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaatgga

SEQ ID NO: 160222 - DNA, 2800 bp, Homo sapiens
  Payload ID: 11336
  Gene Symbol: NSFL1C
  Gene Name: NSFL1 (p97) cofactor (p47)
  Uniprot ID: Q9UNZ2
  ENST ID: ENST00000476071
  CDS Start-End: 95-1213
ggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggagcaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaatgga

SEQ ID NO: 160223 - DNA, 1446 bp, Homo sapiens
  Payload ID: 11336
  Gene Symbol: NSFL1C
  Gene Name: NSFL1 (p97) cofactor (p47)
  ENST ID: ENST00000381653
  CDS Start-End: 1-825
atggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcaggctgtcctgctttcctcccttcaagcccttgttcagttgaagacaccaaggaggaaaaaggccgagtaacttgcccacattactcaggagcgagggagctagcaataacgtatgaaatatatgactcagggtttgaagtgaattctgctggacctgtaagttccataagggcacgattttccctgtctgggtcaatagatcagcagcaccaaacaatgccaggcgcattgcaaatgctcagtaacagtccaagaagggattcccttcttgctaggggccttgtttctgcttgtgttctgatgccatcctctctcctcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagct

SEQ ID NO: 160224 - DNA, 863 bp, Homo sapiens
  Payload ID: 11336
  Gene Symbol: NSFL1C
  Gene Name: NSFL1 (p97) cofactor (p47)
  ENST ID: ENST00000555568
  CDS Start-End: 12-119
acggggcgaagatggcggcggagcgacaggaggcgctgagggagttcgtggcggtgacgggcgccgaggaggaccgggcccgcttctttctcgagtcggccggctgggacttgcagtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacag

SEQ ID NO: 160225 - DNA, 2588 bp, Homo sapiens
  Payload ID: 11336
  Gene Symbol: NSFL1C
  Gene Name: NSFL1 (p97) cofactor (p47)
  ENST ID: ENST00000555944
  CDS Start-End: 82-189
cgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcagtgataatagagtgacatccttcagagacctcattcatgaccaagatgaagatgaggaggaagaggaaggccagaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtgaagcccaaaggagccttcaaagccttcactggcgagggtcagaaactgggcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggatcagcgacatccgactcttcatcgtggatgcccggccagccatggctgccaccagctttatcctcatgactactttcccgaacaaagagctggctgatgagagccagaccctgaaggaagccaacctgctcaatgctgtcatcgtgcagcggttaacataaccgcccagccagctgcctggcctccctcctgtgtttcccatggccagtggccatgccccatggggatcgcccctcctgcccccttgtgcacacccagcagtccagtgcaacgtctcctccatagctctgggttcttagatcttggttggacgtttgttttctccttagttgcatttcctgggtttttgtgatgatcaatggactttaatgaaaaaaaaaataaaaacaaccaaaaaaattgaaggaatatcaccagcatgttgtacggaaactctcccactgaagcaggctttaattgctttaaaattatatttatcttggggcctgtgggaggaaacttccttccatcttctctgcataaaaacttgtggcacacaatgcttattcactagtgtgtcccacccgccagccccacagatgactggaggaaggaggggaaatgtgtagaaagaggcttcgccaccacttgttcccacgagaatatgtcacttgcccagataaaactgggcggcagccagagttccctgaagtgggaagtcagagctccatgcacacagtgtcttcagaaggtgaaaataaatatttccctgtgctccttttactcaacccctggggtatctaatcttgccaggtcttggccagttgagattctgttccacctgcctgcctggccctttcctccattaccatccagactgctcgcctcctggggattctcaggggctccattatggcttgatttactccacgtgcagaagtcttgagtggacctaggaggtaggtgggatattttttttcactaggatacagctcatgccaacccatcctaagtgagttcagaatcagggtatcttgccctataagataaacagtcaaaatgccaccgagctgttcactagtgatgtgtggcaaatcaaatcaactgttgaagaaggggtgagttttctgtgctacaagcacctgtcactgttggtacttgcaggaggcttctgctgggtatgttttggaagtgagtgtcactacttggctttgcttagcaggttctgcttcacacttgttctttgacctgctgacttgtgacttgcagaaacataggcagtagtcctagcctggtaaagaccctccaccacccctataagtttgattgctatgcaggtttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaaccaagacccatcctgagcaagggacttggcttggtgcttttgatcccaaagttcccacaccggcagtggcctgctggggcaatggcatctgtcacggtgttttctccagcaggtggagattatggaacctacatatgggtctggaaaaactgtacactgttgtcaccttgaccattaaaaaccagaatgaggacaatgga

SEQ ID NO: 160226 - DNA, 845 bp, Homo sapiens
  Payload ID: 11336
  Gene Symbol: NSFL1C
  Gene Name: NSFL1 (p97) cofactor (p47)
  ENST ID: ENST00000470376
  CDS Start-End: 6-221
cgaagatggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagagaaaagaggtaggaggaaagtgatcttgtaactgtttgcacgtgctaacctatgagatgttggtgatggcacatctgggtattactgcttgggacatgttgttaggtgataatagagtgacatccttcagagacctcattcatgaccaagatgaagatgaggaggaagaggaaggccagaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagatgttcatgtagtattgaaactctggaagagtggattcagcctggataatggagaactcagaagctaccaagacccatccaatgcccagtttctggagtctatccgcagaggggaggtgccagcagagcttcggaggctagctcacggtggacaggtgaacttggatatggaggaccatcgggacgaggactttgtga

SEQ ID NO: 160227 - DNA, 694 bp, Homo sapiens
  Payload ID: 11336
  Gene Symbol: NSFL1C
  Gene Name: NSFL1 (p97) cofactor (p47)
  ENST ID: ENST00000489203
  CDS Start-End: 1-318
atggcggcggagcgacaggaggcgctgagggagttcgtggcggtgacgggcgccgaggaggaccgggcccgcttctttctcgagtcggccggctgggacttgcagatcgcgctagcgagcttttatgaggacggaggggatgaagacattgtgaccatttcgcaggcaacccccagttcagtgtccagaggcacagcccccagtgataatagagtgacatccttcagagacctcattcatgaccaagatgaagatgaggaggaagaggaaggccagaggggccacagtgtgtgtcacatgaatggcaaggtgaggtgaggcttgggggagctcctggtgctgtgtcacaccaccttacctgtgtgcattactctgtgcttgttcttttgcatacatctgctgatttgaacctcacggctctgacttaaggagcaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagaccatttgcaggaggtggctaccgccttggggcagcaccagaggaagagtctgcctatgtggcaggagaaaagaggcagcattccagccaagat

SEQ ID NO: 160228 - DNA, 722 bp, Homo sapiens
  Payload ID: 11337
  Gene Symbol: NSL1
  Gene Name: NSL1, MIS12 kinetochore complex component
  ENST ID: ENST00000366976
  CDS Start-End: 20-538
cccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacatggtactgaaa

SEQ ID NO: 160229 - DNA, 2317 bp, Homo sapiens
  Payload ID: 11337
  Gene Symbol: NSL1
  Gene Name: NSL1, MIS12 kinetochore complex component
  Uniprot ID: Q96IY1
  ENST ID: ENST00000366977
  CDS Start-End: 20-865
cccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacatggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactggcaaagtgtcattgtgttattgaactatttcacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtcccca

SEQ ID NO: 160230 - DNA, 1344 bp, Homo sapiens
  Payload ID: 11337
  Gene Symbol: NSL1
  Gene Name: NSL1, MIS12 kinetochore complex component
  ENST ID: ENST00000366978
  CDS Start-End: 128-355
ggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccaggagccaagcctggtggactagctctaggggcagtttaggagagaaggggatcggggaaccttcatcccttctgcctctggtgaactggcaagatgaagaggatgaagctgggtgacccagagcccgccctccctctctcggcagtcatctccaaggccggagtagactggactggagggcctctgagaggacacagccaggaagcacactctccctgtgctcttcacccaccatgaagagacaggacgggaaagtccgtgctgtgctggtgtccatcagagggagggacaccatccagcccctgggaccgggctcggctctgttgttgcacagaagtcatttggagatccccacgtgccacatggaggattgtgggaggaccccaccgaggtggctggcagcctctcatggacaccatggagagtgacccaatcactctgcatttgaggactgcagagtggctcagcggtctggacattgaagaggagccaacctcaggggtaacacagtgccgctgggagctgagatgagccaggtggtcggtgggggacacaagcctagaacaaattcaataaaccagccacagacgttatcatcagatgtgcccagagacaaggtggacaggggcatttgctgtggagaccagagggccagagagagtacagggacctggatagatggctccagcacctcttcttctccctacacccatatgccatcttgataaacagcagggaaatctgaaaaataccaagtcttcccatagggacagtgttacctcccaaaaactgtttgaataattggcttgaactggattttctgaactgaactaatgctattgttttgtgggtttttttcttcctactgagtagagtagttgtttatgggggacatctgatcctttcattttcttccagagagctaaccacctgttctgacaccatttattgaatagtacctcttttcccccactgatgtgagaggctgcatttttcatctaataaaatcgaatatatatttagatcta

SEQ ID NO: 160231 - DNA, 790 bp, Homo sapiens
  Payload ID: 11337
  Gene Symbol: NSL1
  Gene Name: NSL1, MIS12 kinetochore complex component
  Uniprot ID: Q96IY1
  ENST ID: ENST00000626725
  CDS Start-End: 14-655
gttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagttctcaacgggaatgctttcaacttttccccattcaacatgatgttggctgtggatttgtcatatatggtttttattacttcgagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaa

SEQ ID NO: 160232 - DNA, 2784 bp, Homo sapiens
  Payload ID: 11338
  Gene Symbol: SGSH
  Gene Name: N-sulfoglucosamine sulfohydrolase
  Uniprot ID: P51688
  ENST ID: ENST00000326317
  CDS Start-End: 88-1596
gaccggggtcggggcagggggcggggccgagcgggagaccagagagccggagccggatcccgatcccgagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctagacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtctgcggacagggcagcgcccccagcccatgacaagggagtcttgttttctggcttggtttggggacctgcaaatgggaggcctgaggccctcttcaggctttggcagccacagatacttctgaacccttcacagagagcaggcaggggcttcggtgccgcgtgggcagtacgcaggtcccaccgacactcacctgggagcacggcgcctggctcttaccagcgtctggcctagaggaagcctttgagcgacctttgggcaggtttctgcttcttctgttttgccccatggtcaagtccctgttccccaggcaggtttcagctgattggcagcaggctccctgagtgatgagcttgaacctgtggtgtttctgggcagaagcttatcttttttgagagtgtccgaagatgaaggcatggcgatgcccgtcctctggcttgggttaattcttcggtgacactggcattgctgggtggtgatgcccgtcctctggcttgggttaattcttcggtgacactggcgttgctgggtggcaatgcccatcctctgccttgggttaattcttcggtgacactggcgttgctgggtggcgatgcccgtcctctggcttgggttaattcttggatgacgtcggcgttgctgggagaatgtgccgttcctgccctgcctccacccacctcgggagcagaagcccggcctggacacccctcggcctggacacccctcgaaggagagggcgcttccttgagtaggtgggctccccttgcccttccctccctatcactccatactggggtgggctggaggaggccacaggccagctattgtaaaagctttttattttagtaaaatatacagaagttctttttctgaactcatttatgatgata

SEQ ID NO: 160233 - DNA, 1546 bp, Homo sapiens
  Payload ID: 11338
  Gene Symbol: SGSH
  Gene Name: N-sulfoglucosamine sulfohydrolase
  ENST ID: ENST00000570923
  CDS Start-End: 26-850
atcccgagtccgagccgccgccgccatgagctgccccgtgcccgcctgctgcgcgctgctgctagtcctggggctctgccgggcgcgtccccggaacgcactgctgctcctcgccgaccgtgcactctctgtctcccacctcacgcagcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctaggtatgcctttgtctgtctccgtcaggaaaggtgtgggagtggatctgggacggggccatgacctgtcagatgctgctccacacccattacctaatgtggctctcatatcatctgggtgaggaagggactgtcactcccactctacagaggaaaagaatgaggctcagagaggtgaagtaagctgctcaggattgcacagctggtaagcactaagctaggattctcgcctggatcctgctgctttcaaaaccattgccttttccccgcctacctccgatgagcttcagaatcacctgggatgcttgttaatatccaaattgcaaatcccagggtgtccgattcagtagatcttggcgggctcaagaatttgcatgtctgacaagttcccaggtgatgccgatactgtgggcctggggacccctctctgagcatccgtgcaccccatcctgccttcctgggggacccaaagcacctcatgaccctgctcattcctaaaaagacctaggacatctagtcccatgttatggatgtgcagac

SEQ ID NO: 160234 - DNA, 2612 bp, Homo sapiens
  Payload ID: 11338
  Gene Symbol: SGSH
  Gene Name: N-sulfoglucosamine sulfohydrolase
  ENST ID: ENST00000573150
  CDS Start-End: 48-731
agagagccggagccggatcccgatcccgagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctagacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacacgtgtccgtgtggccggccagcctggggagtagtggcaacagcccttccgtccacactcccatccaaggagggttcttccttcctgtggggtcactcttgccattgcctggagggggaccagagcatgtgaccagagcatgtgcccagcccctccaccaccaggggcactgccgtcatggcaggggacacagttgtccttgtgtctgaaccatgtcccagcacgggaattctagacatacgtggtctgcggacagggcagcgcccccagcccatgacaagggagtcttgttttctggcttggtttggggacctgcaaatgggaggcctgaggccctcttcaggctttggcagccacagatacttctgaacccttcacagagagcaggcaggggcttcggtgccgcgtgggcagtacgcaggtcccaccgacactcacctgggagcacggcgcctggctcttaccagcgtctggcctagaggaagcctttgagcgacctttgggcaggtttctgcttcttctgttttgccccatggtcaagtccctgttccccaggcaggtttcagctgattggcagcaggctccctgagtgatgagcttgaacctgtggtgtttctgggcagaagcttatcttttttgagagtgtccgaagatgaaggcatggcgatgcccgtcctctggcttgggttaattcttcggtgacactggcattgctgggtggtgatgcccgtcctctggcttgggttaattcttcggtgacactggcgttgctgggtggcaatgcccatcctctgccttgggttaattcttcggtgacactggcgttgctgggtggcgatgcccgtcctctggcttgggttaattcttggatgacgtcggcgttgctgggagaatgtgccgttcctgccctgcctccacccacctcgggagcagaagcccggcctggacacccctcggcctggacacccctcgaaggagagggcgcttccttgagtaggtgggctccccttgcccttccctccctatcactccatactggggtgggctggaggaggccacaggccagctattgtaaaagctttttattttagtaaaatatacagaagttc

SEQ ID NO: 160235 - DNA, 587 bp, Homo sapiens
  Payload ID: 11338
  Gene Symbol: SGSH
  Gene Name: N-sulfoglucosamine sulfohydrolase
  ENST ID: ENST00000574505
  CDS Start-End: 1-320
gggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgt

SEQ ID NO: 160236 - DNA, 583 bp, Homo sapiens
  Payload ID: 11338
  Gene Symbol: SGSH
  Gene Name: N-sulfoglucosamine sulfohydrolase
  ENST ID: ENST00000570427
  CDS Start-End: 21-583
gagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcctctcttcccgcccaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccg

SEQ ID NO: 160237 - DNA, 818 bp, Homo sapiens
  Payload ID: 11338
  Gene Symbol: SGSH
  Gene Name: N-sulfoglucosamine sulfohydrolase
  ENST ID: ENST00000576856
  CDS Start-End: 1-204
gtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctagaggaaaagaatgaggctcagagaggtgaagtaagctgctcaggattgcacagctgacctcacgcccaccatcttggattggttctcgatcccgtaccccagctacgccatctttggctcgaagaccatccacctcactggccggtccctcctgccggcgctggaggccgagcccctctgggccaccgtctttggcagccagagccaccacgaggtcaccatgtcctaccccatgcgctccgtgcagcaccggcacttccgcctcgtgcacaacctcaacttcaagatgccctttcccatcgaccaggacttctacgtctcacccaccttccaggacctcctgaaccgcaccacagctggtcagcccacgggctggtacaaggacctccgtcattactactaccgggcgcgctgggagctctacgaccggagccgggacccccacgagacccagaacctggccaccgacccgcgctttgctcagcttctggagatgcttcgggaccagctggccaagtggcagtgggagacccacgacccctgggtgtgcgcccccgacggcgtcctggaggagaagctctctccccagtgccagcccctccacaatgagctgtgaccatcccaggaggcctgtgcacacatcccaggcatgtcccagacacatcccacac

SEQ ID NO: 160238 - DNA, 546 bp, Homo sapiens
  Payload ID: 11338
  Gene Symbol: SGSH
  Gene Name: N-sulfoglucosamine sulfohydrolase
  ENST ID: ENST00000576707
  CDS Start-End: 216-546
agttgcttctgggaggacatcagaggcgcccggttaattcagcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccagcatcagaatgggatgtacgggctgcaccaggacgtgcaccacttcaactccttcgacaaggtgcggagcctgccgctgctgctcagccaagctggtgtgcgcacaggcatcatcgggaagaagcacgtggggccggagaccgtgtacccgtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttg

SEQ ID NO: 160239 - DNA, 578 bp, Homo sapiens
  Payload ID: 11338
  Gene Symbol: SGSH
  Gene Name: N-sulfoglucosamine sulfohydrolase
  ENST ID: ENST00000576941
  CDS Start-End: 21-347
gagtccgagccgccgccgccatgagctgccccgtgcccgcctgctgcgcgctgctgctagtcctggggctctgccgggcgcgtccccggaacgcactgctgctcctcgcggatgacggaggctttgagagtggcgcgtacaacaacagcgccatcgccaccccgcacctggacgccttggcccgccgcagcctcctctttcgcaatgccttcacctcggtcagcagctgctctcccagccgcgccagcctcctcactggcctgccccaggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtc

SEQ ID NO: 160240 - DNA, 581 bp, Homo sapiens
  Payload ID: 11338
  Gene Symbol: SGSH
  Gene Name: N-sulfoglucosamine sulfohydrolase
  ENST ID: ENST00000572257
  CDS Start-End: 1-581
gtttgactttgcgtacacggaggagaatggctccgtcctccaggtggggcggaacatcactagaattaagctgctcgtccggaaattcctgcagactcaggatgaccggcctttcttcctctacgtcgccttccacgacccccaccgctgtgggcactcccagccccagtacggaaccttctgtgagaagtttggcaacggagagagcggcatgggtcgtatcccagactggaccccccaggcctacgacccactggacgtgctggtgccttacttcgtccccaacaccccggcagcccgagccgacctggccgctcagtacaccaccgtcggccgcatggaccaaggagttggactggtgctccaggagctgcgtgacgccggtgtcctgaacgacacactggtgatcttcacgtccgacaacgggatccccttccccagcggcaggaccaacctgtactggccgggcactgctgaacccttactggtgtcatccccggagcacccaaaacgctggggccaagtcagcgaggcctacgtgagcctcctagtgactaggctacttttgcccactgtaaaag

SEQ ID NO: 160241 - DNA, 1695 bp, Homo sapiens
  Payload ID: 11339
  Gene Symbol: NT5C1B-RDH14
  Gene Name: NT5C1B-RDH14 readthrough
  ENST ID: ENST00000444297
  CDS Start-End: 97-1695
aaatgcaaagctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagggatcacaagaatcatcactgcggaagacagactctcgagggtaccttgtgcgcagtcaatggtctagaatatcccggagcccatccaccaaggctccatccatagatgagcctagaagcaggaacaccagtgctaaggtagagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccgg

SEQ ID NO: 160242 - DNA, 2142 bp, Homo sapiens
  Payload ID: 11339
  Gene Symbol: NT5C1B-RDH14
  Gene Name: NT5C1B-RDH14 readthrough
  ENST ID: ENST00000532967
  CDS Start-End: 95-1903
atgcaaagctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagatgaggcgtgcagtcaatccgaatcactcgctgagatgttgccccttccagggtcactcgtcgtgtagacgctgcctttgtgcagctgagggaacagcccttggcccctgccacacaatacgtatttatattcacatgtgcctgttgtgggagcagggccagcagatcaccatgatgaggggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccgg

SEQ ID NO: 160243 - DNA, 1204 bp, Homo sapiens
  Payload ID: 11340
  Gene Symbol: NTAN1
  Gene Name: N-terminal asparagine amidase
  Uniprot ID: Q96AB6
  ENST ID: ENST00000287706
  CDS Start-End: 94-1026
gcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggaaagagccagacttctcagaggtcagtctgttcaacaagtgggaccccagggccttctgtatgttcagcaaagagagcttgcagtgacctccccaaaggatggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgttttctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggca

SEQ ID NO: 160244 - DNA, 439 bp, Homo sapiens
  Payload ID: 11340
  Gene Symbol: NTAN1
  Gene Name: N-terminal asparagine amidase
  ENST ID: ENST00000568738
  CDS Start-End: 1-57
cccttgatcatgaactccataaaatccttttctgaccacgctcaatgtggaaggtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatg

SEQ ID NO: 160245 - DNA, 738 bp, Homo sapiens
  Payload ID: 11340
  Gene Symbol: NTAN1
  Gene Name: N-terminal asparagine amidase
  ENST ID: ENST00000566419
  CDS Start-End: 69-738
gggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggaaagagccagacttctcagaggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactag

SEQ ID NO: 160246 - DNA, 667 bp, Homo sapiens
  Payload ID: 11340
  Gene Symbol: NTAN1
  Gene Name: N-terminal asparagine amidase
  ENST ID: ENST00000568320
  CDS Start-End: 230-667
aggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagag

SEQ ID NO: 160247 - DNA, 354 bp, Homo sapiens
  Payload ID: 11340
  Gene Symbol: NTAN1
  Gene Name: N-terminal asparagine amidase
  ENST ID: ENST00000563940
  CDS Start-End: 1-84
ctcgtccgagcccacccgcctttggaggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggtgagatctacgctgctctcataggctggaagtacaccttgttggaggcttcagtgacgacaggcagttgtcacaaaaactcactcatcaacttcttagtgaatttgacaggcaagaagatgacattcacttagtgacattatgtgtgacag

SEQ ID NO: 160248 - DNA, 1043 bp, Homo sapiens
  Payload ID: 11340
  Gene Symbol: NTAN1
  Gene Name: N-terminal asparagine amidase
  ENST ID: ENST00000565187
  CDS Start-End: 57-194
gctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgttttctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataa

SEQ ID NO: 160249 - DNA, 1043 bp, Homo sapiens; identical to SEQ ID NO: 160248
  Payload ID: 11340
  Gene Symbol: NTAN1
  Gene Name: N-terminal asparagine amidase
  ENST ID: ENST00000615632
  CDS Start-End: 57-194

SEQ ID NO: 160250 - DNA, 1049 bp, Homo sapiens
  Payload ID: 11340
  Gene Symbol: NTAN1
  Gene Name: N-terminal asparagine amidase
  ENST ID: ENST00000614882
  CDS Start-End: 255-872
aggacgaggcgggacgcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgttttctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggc

SEQ ID NO: 160251 - DNA, 1049 bp, Homo sapiens; identical to SEQ ID NO: 160250
  Payload ID: 11340
  Gene Symbol: NTAN1
  Gene Name: N-terminal asparagine amidase
  ENST ID: ENST00000622833
  CDS Start-End: 255-872

SEQ ID NO: 160252 - DNA, 1204 bp, Homo sapiens; identical to SEQ ID NO: 160243
  Payload ID: 11340
  Gene Symbol: NTAN1
  Gene Name: N-terminal asparagine amidase
  Uniprot ID: Q96AB6
  ENST ID: ENST00000620176
  CDS Start-End: 94-1026

SEQ ID NO: 160253 - DNA, 1115 bp, Homo sapiens
  Payload ID: 11340
  Gene Symbol: NTAN1
  Gene Name: N-terminal asparagine amidase
  ENST ID: ENST00000624579
  CDS Start-End: 321-938
aggacgaggcgggacgcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgttttctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggc

SEQ ID NO: 160254 - DNA, 667 bp, Homo sapiens; identical to SEQ ID NO: 160246
  Payload ID: 11340
  Gene Symbol: NTAN1
  Gene Name: N-terminal asparagine amidase
  ENST ID: ENST00000631580
  CDS Start-End: 230-667

SEQ ID NO: 160255 - DNA, 738 bp, Homo sapiens; identical to SEQ ID NO: 160245
  Payload ID: 11340
  Gene Symbol: NTAN1
  Gene Name: N-terminal asparagine amidase
  ENST ID: ENST00000634013
  CDS Start-End: 69-738

SEQ ID NO: 160256 - DNA, 354 bp, Homo sapiens; identical to SEQ ID NO: 160247
  Payload ID: 11340
  Gene Symbol: NTAN1
  Gene Name: N-terminal asparagine amidase
  ENST ID: ENST00000633231
  CDS Start-End: 1-84

SEQ ID NO: 160257 - DNA, 439 bp, Homo sapiens; identical to SEQ ID NO: 160244
  Payload ID: 11340
  Gene Symbol: NTAN1
  Gene Name: N-terminal asparagine amidase
  ENST ID: ENST00000633749
  CDS Start-End: 1-57

SEQ ID NO: 160258 - DNA, 5289 bp, Homo sapiens
  Payload ID: 11341
  Gene Symbol: NECAB1
  Gene Name: N-terminal EF-hand calcium binding protein 1
  Uniprot ID: Q8N987
  ENST ID: ENST00000417640
  CDS Start-End: 338-1393
aggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggagggggggacaccgagcgcggagagcgcggagagcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtgaatatttttctcagcacttgggcgagtatgagaatgtactagcagcacttgaagacctgaatctttccatcctgaaggcaatgggcaaaacaaagaaagactaccaagaagcctccaatttggaacaattcgtaactagatttttattgaaggaaaccctgaatcagctgcagtctctccagaattccctggaatgtgccatggaaactactgaggagcaaacccgtcaagaaaggcaagggccagccaagccagaagtcctgtcgattcaatggcctggaaaacgatcaagccgccgagtccagagacacaacagcttctccccaaacagccctcagtttaatgtcagcggtccaggcttattagaagaagacaaccagtggatgacccagataaatagactccagaaattaattgatagactggaaaagaaggatctcaaactcgaaccaccagaagaagaaattattgaagggaatactaaatctcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatgtctactccatccccaacccaactcacagccctatgactactatctttgcattagttaaaaagttagtatataggcatcaaacaaccttggctgtaacctatagaatctctatccacgtatcaggttatagactggtttttcaaaagtgaacaatcctgtgataagttggagtaccatttagtaatacagcaacattgtgtcatttattagcatcataattctttgttatgtaagttaaatatatcaagaaagaagagactgtttggaaaaatgtggttcaagttttatgctatatagttttggtatgcgatacagacagctaacttttcttatgaaaaatacatatttgcatgtaaacaatgatttcaaaatacttgaaaaataaaattttaacccaaatgaataactaagaaatataaaacaagcacaaaatcttagggaagtcataaaatagtagtgaaagtattagacagaagacatctgttttcgaatttcaacactagaatgactaaaactatctacctatagaactatctgtagatagtatactatctacactctgctcaacaagctcagaaattaaatatttttaataataaaaatctgttctggttataaaccttgctaatgaaaatacaatacatataaaaatgtatagccatgttattttctagtataaattcctttgaaactataagtctttgaggaaaattataaggtaaaattttcctgtttttccccctttgaaaaactcaggaaaaaaggaagattgaactaataaaattttatttcttaaatataaatttgacctaaaatattttctcaaactaattcatgaaacagcaacttttaccaatacctttgtatactctcagttctcattcagtataaataaaattttaaaatcctttcatagttctattagaaataagtagtaaattttgatatattgtacatacacacgtgtgtgtgtgtgtgtgtgtgtgtgtgtgtgtgtgtgtgtgtatttgtgtgcctctggtcaactctaaggatgacagacactgtgtaacaacacctgggtcaactcttttaatttatatacaaagcaaagaacaacattaatggagatgcacaatgattattcaaacaagctatatatatgtacaaaggcaaacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataaaaaaaaatttaaaaaattaaaaaataaaaaaaagaggtcactaaaagaccaagatgggaaacgtaacatggaatacaagcttgaatctgggaaacaagctcaaaaaacagtgaaaaaaaaagtactggtttaggagttcaaaattcagtgaaacaaactttttgccaatagacctagggatctaagaaatagaattagggagagtttacacttacttacctatatatcagcagatttttctggaagaaaccctttttttttttttttttaaacagtaacatccagagtgacaaattgcaggagatttaatgtataaaatttctaggaattaaaagcttaaacccaaaaattgttcatccatatataagaaattatcgaattaaaacttaatgtatgtcaattattttcaaatgtctaaattcctttggaaataaaaatatcagttttactttgaaattgctcaacttctgctattcatatggtctgattagtgacataagtagcagccgtttttcaacttcagtttcattcactaccattgtttccaaattatcaatctctgctagtaattatgaatttaagaccatattattatcaaaaacctagagaccaatcatatatctgaaaagaaatacccattaaaaattctgcctcctgtttattgagaactatgcattgaacattctgaatcattctaagcctctggagagactgtaatgatccattcatgagctggtatgaaatcagtgggaagcagaacaacagaaggaactttaaaagcaacaagcaattatgtaccatatatacactgtagcaaatattttatatttgagagtctttacagcttacatttccattccattattacaagtgatgaaaaacaaaaaattgcaagtagtatgcaaattataaatatacagtcttcccacttcactaaccaaattcctactttccagtgttacttcccaatttatgcaggaaacctcctgcaaagctgaaactgattagaaaattctttatattttaaaatagctctttctcatttttagagaagtcaaatagccaaccatcaaaattaagaataaattgaattgtcacagtccattacagttattgttgctagatccacctcatttgcagatgtccaaacttaaattcatctgttcttaaaatgctacttaaaactttggttgttttcctgtaatataaaagaaaaagttaatttatcaattgattgaatacagtttttactaattagtttatcaaaccaaatactgtgaacgtaccaggtgtttacagatttaaatgcatgttaccatagaaactattaaagtaactagaactgtcaaataacaaaacggctcatgtttttaaaatatatgtaactcattttaaaatatattaaattgtattccaaacctgttcttctgtttctgtggcacctaggtttaaaatatgtattaatgtgtaaatcacaagtaaaatgaattctaatgtacaagtttgttttaaaaagtgtatgtcaagcttttatttacacaataaaatgttattaaagatggaaagtctacaaatg

SEQ ID NO: 160259 - DNA, 2908 bp, Homo sapiens
  Payload ID: 11341
  Gene Symbol: NECAB1
  Gene Name: N-terminal EF-hand calcium binding protein 1
  Uniprot ID: Q8N987
  ENST ID: ENST00000521366
  CDS Start-End: 271-573
attgagaatcactgcttttaaagggaaacacgtcattgtaaagaacacgttgtttagcttctgggactagaggcaaggaaaatatcttgcctagattacagcctttatacagttttatacttggaatagtcatggccttccttggtcatatttttggatgacaatcatctgtttttgtgaggaggaatgggatgggcagtaggagtcagcttaaatcgggctccgtgacagccaacgcagtgaccctcgccccttccttggcagcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatgtctactccatccccaacccaactcacagccctatgactactatctttgcattagttaaaaagttagtatataggcatcaaacaaccttggctgtaacctatagaatctctatccacgtatcaggttatagactggtttttcaaaagtgaacaatcctgtgataagttggagtaccatttagtaatacagcaacattgtgtcatttattagcatcataattctttgttatgtaagttaaatatatcaagaaagaagagactgtttggaaaaatgtggttcaagttttatgctatatagttttggtatgcgatacagacagctaacttttcttatgaaaaatacatatttgcatgtaaacaatgatttcaaaatacttgaaaaataaaattttaacccaaatgaataactaagaaatataaaacaagcacaaaatcttagggaagtcataaaatagtagtgaaagtattagacagaagacatctgttttcgaatttcaacactagaatgactaaaactatctacctatagaactatctgtagatagtatactatctacactctgctcaacaagctcagaaattaaatatttttaataataaaaatctgttctggttataaaccttgctaatgaaaatacaatacatataaaaatgtatagccatgttattttctagtataaattcctttgaaactataagtctttgaggaaaattataaggtaaaattttcctgtttttccccctttgaaaaactcaggaaaaaaggaagattgaactaataaaattttatttcttaaatataaatttgacctaaaatattttctcaaactaattcatgaaacagcaacttttaccaatacctttgtatactctcagttctcattcagtataaataaaattttaaaatcctttcatagttctattagaaataagtagtaaattttgatatattgtacatacacacgtgtgtgtgtgtgtgtgtgtgtgtgtgtgtgtgtgtgtgtgtatttgtgtgcctctggtcaactctaaggatgacagacactgtgtaacaacacctgggtcaactcttttaatttatatacaaagcaaagaacaacattaatggagatgcacaatgattattcaaacaagctatatatatgtacaaaggcaaacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataaaaaaaaatttaaaaa

SEQ ID NO: 160260 - DNA, 811 bp, Homo sapiens
  Payload ID: 11341
  Gene Symbol: NECAB1
  Gene Name: N-terminal EF-hand calcium binding protein 1
  Uniprot ID: Q8N987
  ENST ID: ENST00000522820
  CDS Start-End: 203-505
atttgaacagggcctgttgtaagtagttaatgtgtttgacaaccctgtaatatttgatatacctttggaaatgcatgagttactaatttttttgaaatctagttgtttgtaatgattgtcacttatgtctaatatcacaaaatattcaagaaattggagctgtgcaatgaacaataggacttctctttaaaaattgcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataat

SEQ ID NO: 160261 - DNA, 1608 bp, Homo sapiens
  Payload ID: 11342
  Gene Symbol: NECAB2
  Gene Name: N-terminal EF-hand calcium binding protein 2
  Uniprot ID: Q7Z6G3
  ENST ID: ENST00000305202
  CDS Start-End: 18-1178
gcggcgggcgcggcgcgatgtgcgagcgggcggcgcgcctgtgcagggccggcgcgcacaggctgctccgggagccgccgcagcagggccgggcgctgggcgggctgctgcgctgggtgggcgccaggatgggcgagccccgggagtcgctggcccccgccgcccccgcggaccccggcccagcctcgccgcgcgggggcaccgccgtcatcctggacattttccgccgtgcggacaaaaatgatgatgggaagctgtccttggaggaattccagctcttctttgcagatggcgtccttaatgagaaagaactggaggatctctttcacacgattgactctgacaacaccaaccatgtggacaccaaggagctgtgtgattactttgtggaccacatgggtgactatgaggatgtcctggcctccctggagaccttgaatcactctgtcctgaaggccatgggttataccaagaaggtatatgagggtgggagcaacgtggaccagtttgtgacccgcttcctcctgaaggagacggccaatcagatccagtcgctgctgagctcagtggagagtgcggtggaggccatcgaggaacagaccagccagctccgacagaaccacatcaaacccagccacagcgcggcacagacctggtgtggaagccccactcccgcctctgcccccaaccacaagctcatggctatggaacaaggcaagacccttccatctgccacggaggatgcaaaggaagagggtctggaagcccagatcagccgcttggcagagctgattgggaggctggagagcaaagcactgtggttcgacctgcagcagcgcctgtcagatgaagatggcaccaacatgcacctgcagctggtccggcaggagatggccgtgtgccccgagcaactgagcgagtttctggactctctgcgccagtatctgcgggggaccactggcgtgaggaactgcttccacatcactgccgtgaggctctcagatggcttcacctttgtcatctatgagttctgggagacagaggaggcgtggaagaggcacctgcagagccccctgtgtaaggcgttccggcacgtcaaggtggacacactgagccagcctgaggccctctccaggatcttggtgccagctgcttggtgcacggtgggacgggactgacagcctcccagaggcccgtggaggagcccaccagccccttcttcttgtgaaggaaatcccgtttttttctagacagacactttggtgcagaagcttcttttcaatccatcctccacaagaaggtgtttccctgttgttaagtgaaggaggccgcccctgcccccacctgagaaggcagagcagtgtctgtgctgccaggtcctggtgaagcccaaggttgaagggggcggcttcctggagccagcacccctgcctcctggtcctggcctctcccctacccctcacatggccacgcatgacccacactgaccacaccctgccctcttcggtgacattcttctacctagtaggagtcatgcccctgtagtgcccaacctagccaggtagccaccactgtgcccaggcgccaaataaaccctggttgggaaga

SEQ ID NO: 160262 - DNA, 549 bp, Homo sapiens
  Payload ID: 11342
  Gene Symbol: NECAB2
  Gene Name: N-terminal EF-hand calcium binding protein 2
  ENST ID: ENST00000566836
  CDS Start-End: 1-549
aacaccaaccatgtggacaccaaggagctgtgtgattactttgtggaccacatgggtgactatgaggatgtcctggcctccctggagaccttgaatcactctgtcctgaaggccatgggttataccaagaaggtatatgagggtgggagcaacgtggaccagtttgtgacccgcttcctcctgaaggagacggccaatcagatccagtcgctgctgagctcagtggagagtgcggtggaggccatcgaggaacagaccagccagctccgacagaaccacatcaaacccagccacagcgcggcacagacctggtgtggaagccccactcccgcctctgcccccaaccacaagctcatggctatggaacaaggcaagacccttccatctgccacggaggatgcaaaggaagagggtctggaagcccagatcagccgcttggcagagctgattgggaggctggagagcaaacacctgcagctggtccggcaggagatggccgtgtgccccgagcaactgagcgagtttctggactctctgcgccagtatctg

SEQ ID NO: 160263 - DNA, 617 bp, Homo sapiens
  Payload ID: 11342
  Gene Symbol: NECAB2
  Gene Name: N-terminal EF-hand calcium binding protein 2
  ENST ID: ENST00000564166
  CDS Start-End: 1-187
gagcgagtttctggactctctgcgccagtatctgcgggggaccactggcgtgaggaactgcttccagcacctgcagagccccctgtgtaaggcgttccggcacgtcaaggtggacacactgagccagcctgaggccctctccaggatcttggtgccagctgcttggtgcacggtgggacgggactgacagcctcccagaggcccgtggaggagcccaccagccccttcttcttgtgaaggaaatcccgtttttttctagacagacactttggtgcagaagcttcttttcaatccatcctccacaagaaggtgtttccctgttgttaagtgaaggaggccgcccctgcccccacctgagaaggcagagcagtgtctgtgctgccaggtcctggtgaagcccaaggttgaagggggcggcttcctggagccagcacccctgcctcctggtcctggcctctcccctacccctcacatggccacgcatgacccacactgaccacaccctgccctcttcggtgacattcttctacctagtaggagtcatgcccctgtagtgcccaacctagccaggtagccaccactgtgcccaggcgccaaataaaccctggttgggaaga

SEQ ID NO: 160264 - DNA, 2064 bp, Homo sapiens
  Payload ID: 11342
  Gene Symbol: NECAB2
  Gene Name: N-terminal EF-hand calcium binding protein 2
  ENST ID: ENST00000565691
  CDS Start-End: 723-1634
ggaaaggggagcagctctgtcccacggattcagatgtcactggaaaggcagaacgaggaggcacctggtcttgtaggttcaggccagccttggagctgccctccacccatccctgcctaatgcagccggaacttcgtctgcggctgcttttctgaactcttggcgtcctgtttctcctcctgcaccccaaaattaacgcagtcctgcccgtggctggcattgtcaccaggccttgcaaacacctctgtcggactttgcccaacctccctggaaacacaccaggggttttggaaggactgcagtggtaaaggttgtggcgctccctgggacactgattcggagtgtggttgtgtgcagctgagcgtttggcggtgggtgaagccacgtggactgatgactgtggacctacacctgcagggatggccgtgggcctgcgtgtgtgtgtcagcgtggctgggagcaggctggtggtactggcagccgcttccacgtgggtgaggggagggcctctgtctgcaacatccctcatcagttccccctggatcccagcccggggagggggagagggaaggggggctcagcttcccaggaccctaagctgctcctgggagaagagaaggatcccagtatccggtcagaggctgcaggaagcgcttgcctctccctggcccagggctgactccgcctctcttttctgcagattttccgccgtgcggacaaaaatgatgatgggaagctgtccttggaggaattccagctcttctttgcagatggcgtccttaatgagaaagaactggaggatctctttcacacgattgactctgacaacaccaaattactttgtggaccacatgggtgactatgaggatgtcctggcctccctggagaccttgaatcactctgtcctgaaggccatgggttataccaagaaggtatatgagggtgggagcaacgtggaccagtttgtgacccgcttcctcctgaaggagacggccaatcagatccagtcgctgctgagctcagtggagagtgcggtggaggccatcgaggaacagaccagccagctccgacagaaccacatcaaacccagccacagcgcggcacagacctggtgtggaagccccactcccgcctctgcccccaaccacaagctcatggctatggaacaaggcaagacccttccatctgccacggaggatgcaaaggaagagggtctggaagcccagatcagccgcttggcagagctgattgggaggctggagagcaaagcactgtggttcgacctgcagcagcgcctgtcagatgaagatggcaccaacatgcacctgcagctggtccggcaggagatggccgtgtgccccgagcaactgagcgagtttctggactctctgcgccagtatctgcgggggaccactggcgtgaggaactgcttccacatcactgccgtgaggctctcagatggcttcacctttgtcatctatgagttctgggagacagaggaggcgtggaagaggcacctgcagagccccctgtgtaaggcgttccggcacgtcaaggtggacacactgagccagcctgaggccctctccaggatcttggtgccagctgcttggtgcacggtgggacgggactgacagcctcccagaggcccgtggaggagcccaccagccccttcttcttgtgaaggaaatcccgtttttttctagacagacactttggtgcagaagcttcttttcaatccatcctccacaagaaggtgtttccctgttgttaagtgaaggaggccgcccctgcccccacctgagaaggcagagcagtgtctgtgctgccaggtcctggtgaagcccaaggttgaagggggcggcttcctggagccagcacccctgcctcctggtcctggcctctcccctacccctcacatggccacgcatgacccacactgaccacaccctgccctcttcggtgacattcttctacctagtaggagtcatgcccctgtagtgcccaacctagccaggtagccaccactgtgcccaggcgccaaataaaccctggttgggaaga

SEQ ID NO: 160265 - DNA, 1989 bp, Homo sapiens
  Payload ID: 11343
  Gene Symbol: NECAB3
  Gene Name: N-terminal EF-hand calcium binding protein 3
  Uniprot ID: Q96P71
  ENST ID: ENST00000246190
  CDS Start-End: 57-1247
ccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggtgagggccgtggggccagggccccacaagggaggaccctcctggtatccaccagagccaggcccatgctggaggcccggcccacactctgtgccctcacaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccaggacttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 160266 - DNA, 1942 bp, Homo sapiens
  Payload ID: 11343
  Gene Symbol: NECAB3
  Gene Name: N-terminal EF-hand calcium binding protein 3
  Uniprot ID: Q96P71
  ENST ID: ENST00000375238
  CDS Start-End: 112-1200
gagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccaggacttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 160267 - DNA, 925 bp, Homo sapiens
  Payload ID: 11343
  Gene Symbol: NECAB3
  Gene Name: N-terminal EF-hand calcium binding protein 3
  ENST ID: ENST00000439478
  CDS Start-End: 58-925
gccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaagcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcct

SEQ ID NO: 160268 - DNA, 1373 bp, Homo sapiens
  Payload ID: 11343
  Gene Symbol: NECAB3
  Gene Name: N-terminal EF-hand calcium binding protein 3
  ENST ID: ENST00000485399
  CDS Start-End: 38-616
cagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggcttatcccgtcctggggccccagtcctcggccctgtgagcctcacttcctctaggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccaggacttgtctcctcctggacttgggcctggtggaagggctctcagcccagggatcagggactgggctgcttgctttctatttattattgatttatttatccctgta

SEQ ID NO: 160269 - DNA, 900 bp, Homo sapiens
  Payload ID: 11343
  Gene Symbol: NECAB3
  Gene Name: N-terminal EF-hand calcium binding protein 3
  ENST ID: ENST00000606690
  CDS Start-End: 8-900
cggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggag

SEQ ID NO: 160270 - DNA, 625 bp, Homo sapiens
  Payload ID: 11343
  Gene Symbol: NECAB3
  Gene Name: N-terminal EF-hand calcium binding protein 3
  ENST ID: ENST00000493590
  CDS Start-End: 15-230
cgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacag

SEQ ID NO: 160271 - DNA, 732 bp, Homo sapiens
  Payload ID: 11343
  Gene Symbol: NECAB3
  Gene Name: N-terminal EF-hand calcium binding protein 3
  ENST ID: ENST00000480994
  CDS Start-End: 356-732
gagatggctaggactgatccttttagatcctaagaagcccccgggaggagcagaactttgagggcgaaggggccttgtggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccct

SEQ ID NO: 160272 - DNA, 2142 bp, Homo sapiens
  Payload ID: 11343
  Gene Symbol: NECAB3
  Gene Name: N-terminal EF-hand calcium binding protein 3
  ENST ID: ENST00000488489
  CDS Start-End: 69-233
acaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtatgtaagggtgctgtcaacctgtggggctagtgcacaagcgcccattgtacccccattccaaatccccacagtcccagcatcctggagcctgcattttcgggcggggaagccatggcagggtagccatggcggggtgaaatgagactggctttggggctaggcctcggagtcccaggaggcttgtcttccccacccaggcttatcccgtcctggggccccagtcctcggccctgtgagcctcacttcctctaggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccaggacttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcc

SEQ ID NO: 160273 - DNA, 969 bp, Homo sapiens
  Payload ID: 11343
  Gene Symbol: NECAB3
  Gene Name: N-terminal EF-hand calcium binding protein 3
  ENST ID: ENST00000607805
  CDS Start-End: 57-689
ccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcgatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggt

SEQ ID NO: 160274 - DNA, 438 bp, Homo sapiens
  Payload ID: 11343
  Gene Symbol: NECAB3
  Gene Name: N-terminal EF-hand calcium binding protein 3
  ENST ID: ENST00000473892
  CDS Start-End: 1-287
tccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggtgagtggagtggctgatggtgggggatccactgtgaggcagtgggcatctgctgtgctgtgggatcctccacagtcttgactcagggttatagagctaggggcttgggttcaaatcctggctcccactttgtagctgtgccccttgacctctctgggcctgtttcctcatctgtaaaccatcataacaatagagctgcccttcatacatcactgtgaccagtgagaacgaa

SEQ ID NO: 160275 - DNA, 852 bp, Homo sapiens
  Payload ID: 11344
  Gene Symbol: NTMT1
  Gene Name: N-terminal Xaa-Pro-Lys N-methyltransferase 1
  Uniprot ID: Q9BV86
  ENST ID: ENST00000372480
  CDS Start-End: 153-824
cgcgtccccaagaggtctacgggccggacctgggcagggactacggagcagtccatgggtcggggtacaggaggaaagtcaaggcactcaaagcccaggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaa

SEQ ID NO: 160276 - DNA, 741 bp, Homo sapiens
  Payload ID: 11344
  Gene Symbol: NTMT1
  Gene Name: N-terminal Xaa-Pro-Lys N-methyltransferase 1
  Uniprot ID: Q9BV86
  ENST ID: ENST00000372481
  CDS Start-End: 146-583
agctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggct

SEQ ID NO: 160277 - DNA, 1315 bp, Homo sapiens
  Payload ID: 11344
  Gene Symbol: NTMT1
  Gene Name: N-terminal Xaa-Pro-Lys N-methyltransferase 1
  Uniprot ID: Q9BV86
  ENST ID: ENST00000372483
  CDS Start-End: 178-849
gcgagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctg

SEQ ID NO: 160278 - DNA, 1487 bp, Homo sapiens
  Payload ID: 11344
  Gene Symbol: NTMT1
  Gene Name: N-terminal Xaa-Pro-Lys N-methyltransferase 1
  Uniprot ID: Q9BV86
  ENST ID: ENST00000372486
  CDS Start-End: 350-1021
gctccgaggtgccccatgtgcggcaggaagaagcagcctccacaggactgcgctcagcgggagacggggcttccccgtgaagaggtgctgagtgcgaatgcccactccaacacctggtcactgtgtgatcttgagaaagagttgagcctctctgggccctggcttccccaacaaccaaaggctgtacagagagcggcttaggagagagctcctgtgtgcgccgccgagggctctgctggctcaggacatctgtaggaccagttccagctccagtgggcaccgccagcacgcccaggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctg

SEQ ID NO: 160279 - DNA, 1072 bp, Homo sapiens
  Payload ID: 11344
  Gene Symbol: NTMT1
  Gene Name: N-terminal Xaa-Pro-Lys N-methyltransferase 1
  ENST ID: ENST00000482347
  CDS Start-End: 199-606
ggcggagctgcggttggcttgtggcgtctccgccgccgccgccctcccttcctcttccccatcttcttctctcggtcccgggagcccccgcccggagaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctg

SEQ ID NO: 160280 - DNA, 576 bp, Homo sapiens
  Payload ID: 11344
  Gene Symbol: NTMT1
  Gene Name: N-terminal Xaa-Pro-Lys N-methyltransferase 1
  ENST ID: ENST00000481189
  CDS Start-End: 176-388
gagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggc

SEQ ID NO: 160281 - DNA, 1123 bp, Homo sapiens
  Payload ID: 11344
  Gene Symbol: NTMT1
  Gene Name: N-terminal Xaa-Pro-Lys N-methyltransferase 1
  ENST ID: ENST00000459968
  CDS Start-End: 151-480
ggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggtaggcaggtctggcgtgctctccaggagaggctgtggctctggtggcactgccgagtccatgtggggtgccaccttttacacatgtaacactgcaggattgttggctatctcttggtacctaccccaaagccttgaggagctgggctgggtgggcacagtggggtaacttctagattgtggacttagcctcagggttaccagacaggagctggctgttaggcagaattgaggtgcctgaattgggcaaacctctcttcaactgttgggttttgccagggacgaaacccttgctctcctgccatgtccacgggtgtttggactgagggtgttggctattctggacgaagactcctagttatgtgccatggtttccaccctctgctccacccccagccttttctgtaccaggctgggacccccagtcctggagccccccaccttcttgtctcatggctggcactggaggctgctgttggccacctgctccatccagcgcctcccctccctccatgttccctctctgcacccttgttcacctgttgccccgcttccattctccccattcctctctgccgttgtttacctggagactcaggagagattagtgcacctgttcaagttatcacctttaagtggaaattagctttcatttagaaatgtgtggcccagggcaggggcagtggctcactcctgtcatcccagccccttgggatgccaaggtgagaggattgcttgagcccaggagtttgagaccagcctgggcaacagaccgaggccccgtctctacaaaaaatacaaaaaaaaaaaaa

SEQ ID NO: 160282 - DNA, 1501 bp, Homo sapiens
  Payload ID: 11344
  Gene Symbol: NTMT1
  Gene Name: N-terminal Xaa-Pro-Lys N-methyltransferase 1
  Uniprot ID: Q9BV86
  ENST ID: ENST00000613644
  CDS Start-End: 163-834
ggccctggctgcctgggcgccgattcccgggacgcgccggccgacagcaggggaggcggcagcagggaccgcagcagcccccgcttccgcacggcccgccgggtcgcggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaat

SEQ ID NO: 160283 - DNA, 1562 bp, Homo sapiens
  Payload ID: 11344
  Gene Symbol: NTMT1
  Gene Name: N-terminal Xaa-Pro-Lys N-methyltransferase 1
  Uniprot ID: Q9BV86
  ENST ID: ENST00000611055
  CDS Start-End: 224-895
ggacaaaggcagcgcgcgccgcgagctgtcgcgtctggtcgtggtctggcggagctgcggttggcttgtggcgtctccgccgccgccgccctcccttcctcttccccatcttcttctctcggtcccgggagcccccgcccggagtgagtagcgcgaggcggtgcgaagggagagtcgcggttgctgatcgtggtgcttgagtagagccgtggttggtgacagcatgacgagcgaggtgatagaagacgagaagcaattctattccaaggccaagacctactggaaacaaatcccacccacggtggacggcatgcttggggggtatggccacatctccagcatcgacatcaacagctcccggaagtttctgcagaggtttttgagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaat

SEQ ID NO: 160284 - DNA, 1346 bp, Homo sapiens
  Payload ID: 11344
  Gene Symbol: NTMT1
  Gene Name: N-terminal Xaa-Pro-Lys N-methyltransferase 1
  ENST ID: ENST00000617943
  CDS Start-End: 272-679
ggacaaaggcagcgcgcgccgcgagctgtcgcgtctggtcgtggtctggcggagctgcggttggcttgtggcgtctccgccgccgccgccctcccttcctcttccccatcttcttctctcggtcccgggagcccccgcccggagtgagtagcgcgaggcggtgcgaagggaaggcccgaacaagacaggaacgtcctgtgccctggactgtggagctggcattgggaggatcaccaagcggctgctcctgccgctgttcagagaggtggatatggtcgacataacggaggacttcctggttcaagccaagacctacctgggggaggagggcaagagggtgaggaactacttctgttgtgggctccaggacttcaccccggagccggactcttacgacgtgatctggatccagtgggtgataggccacctcaccgatcagcacctggccgagttcctgcggcgctgcaagggcagcctccgccccaacggcatcatcgtcatcaaagacaacatggcccaggagggcgtgattctggacgacgtggacagcagcgtgtgccgggaccttgacgtggtccgcaggatcatctgcagtgcaggcctcagcctcctggccgaggagaggcaggagaacctccccgatgagatctaccatgtctatagctttgccctgagatgagccggggctggcaggagaaactgaggaaccacagtcctggtggggggagctggcagctgggcaagatccaggcgccacgctggcggttcgtgagtgtcgaggcaccactaaatatagctgtctgccgtccactcattatgcgggctcttcttcaaaaggcaaggtgggacccggcggggagggtgctgctgaaccagcggtgaggcaggagcccagaccctgctctcctgcgagatgggattgggtggaaggggctccagggctcctggtgctccccatgtgggaatagggtggccacatcagtaaccgattccctgggcctccagcccggccttccagccatgggcctggctgcctgaagaggaaggaaaccacccccaacttggttgctggggacttgaagacttcagtgtgatctttacctaggggagggacagagctgggctggtggagcccatgggtgctgcctgatggtgctgtggggtgggtgctcatgtgccaagtcctgcttggcagtggagacctggggcccttaaagtgttacaacagcctgcagcaagggaagttccccgtagcctcagtcttctctgggcttgaggctgctccttggcaggcatttaaagtaaaaaataaaatggggctgggcgcggtggctcacgcctgtaat

SEQ ID NO: 160285 - DNA, 1067 bp, Homo sapiens
  Payload ID: 11345
  Gene Symbol: NTHL1
  Gene Name: nth-like DNA glycosylase 1
  Uniprot ID: P78549
  ENST ID: ENST00000219066
  CDS Start-End: 20-958
ggccgcatgggccgccgggatgtgtagtccgcaggagtccggcatgaccgccttgagcgcgaggatgctgacccggagccggagcctgggacccggggctgggccgcgggggtgtagggaggagcccgggcctctccggagaagagaggctgcagcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaaggtacgcaggtaccaggtgctgctgtcactgatgctctccagccaaaccaaagaccaggtgacggcgggcgccatgcagcgactgcgggcgcggggcctgacggtggacagcatcctgcagacagatgatgccacgctgggcaagctcatctaccccgtcggtttctggaggagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattgcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgcagatgg

SEQ ID NO: 160286 - DNA, 814 bp, Homo sapiens
  Payload ID: 11345
  Gene Symbol: NTHL1
  Gene Name: nth-like DNA glycosylase 1
  ENST ID: ENST00000566380
  CDS Start-End: 1-710
ggagcctgggacccggggctgggccgcgggggtgtagggaggagcccgggcctctccggagaagagaggctgcagcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaagagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattgcagcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgca

SEQ ID NO: 160287 - DNA, 1052 bp, Homo sapiens
  Payload ID: 11345
  Gene Symbol: NTHL1
  Gene Name: nth-like DNA glycosylase 1
  ENST ID: ENST00000561841
  CDS Start-End: 1-655
gcccgggcctctccggagaagagaggctgcagcagaagcgaggaaaagccacagccccgtgaagcgtccgcggaaagcacagagactgcgtgtggcctatgagggctcggacagtgagaaaggtgagggggctgagcccctcaaggtgccagtctgggagccccaggactggcagcaacagctggtcaacatccgtgccatgaggaacaaaaaggatgcacctgtggaccatctggggactgagcactgctatgactccagtgcccccccaaaggtacgcaggtaccaggtgctgctgtcactgatgctctccagccaaaccaaagaccaggtgacggcgggcgccatgcagcgactgcgggcgcggggcctgacggtggacagcatcctgcagacagatgatgccacgctgggcaagctcatctaccccgtcggtttctggaggagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattggtgtctgtgggcctgaccacctgcaaggagaccccagggctgcctcctaggggttccccgaaagagaaacgctctcagttaaaatgtcagagctggctgggtacaagggctcaagcctgtaatcccagcactttggaaggccgagcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagcca

SEQ ID NO: 160288 - DNA, 837 bp, Homo sapiens
  Payload ID: 11345
  Gene Symbol: NTHL1
  Gene Name: nth-like DNA glycosylase 1
  ENST ID: ENST00000568513
  CDS Start-End: 1-301
ccggagccggagcctgggacccggggctgggccgcgggggtgtagggaggagcccgggcctctccggagaagagaggctgcagcagaagcgaggaaaagccacagccccgtgaagcgtccgcggaaagcacagagactgcgtgtggcctatgagggctcggacagtgagaaaggtacgcaggtaccaggtgctgctgtcactgatgctctccagccaaaccaaagaccaggtgacggcgggcgccatgcagcgactgcgggcgcggggcctgacggtggacagcatcctgcagacagatgatgccacgctgggcaagctcatctaccccgtcggtttctggaggagcaaggtgaaatacatcaagcagaccagcgccatcctgcagcagcactacggtggggacatcccagcctctgtggccgagctggtggcgctgccgggtgttgggcccaagatggcacacctggctatggctgtggcctggggcactgtgtcaggcattgcagtggacacgcatgtgcacagaatcgccaacaggctgaggtggaccaagaaggcaaccaagtccccagaggagacccgcgccgccctggaggagtggctgcctagggagctgtggcacgagatcaatggactcttggtgggcttcggccagcagacctgtctgcctgtgcaccctcgctgccacgcctgcctcaaccaagccctctgcccggccgcccagggtctctgatggccgcatggctctggccgaggtgccgctgtggccaccgtctgtgaagtggctttacgcttcaggaagccacgcctgttgaataaagctttggtgtgtttgc

SEQ ID NO: 160289 - DNA, 4687 bp, Homo sapiens
  Payload ID: 11346
  Gene Symbol: NKPD1
  Gene Name: NTPase, KAP family P-loop domain containing 1
  ENST ID: ENST00000317951
  CDS Start-End: 1-2499
atgcacaaacattacaaagtccacttcgccaaggatgcccagagccccaacgggcactacttctgggacccagagttggggcaccgaaaaggatgctgtcatcagtggcgccaggactcagcggccctccgagcccatgggccctgtcggccttccccccaatcacactggcagctggcctaccacagccaccaagtgggtggcagtggctggcgccggggcctcctgccctccgtcctgcagcagcagcggcagccccagtcccagccctcacctcccagccccctgcggcagcggctctgccccattcacgaagcccagaaggggctgcctgcaacctccactgtccccaaggaacctgccagcgcccctcaggcgcccaccttacccaccacggcaccagccatggccaggagtggcccagctctaccctccgcggctggcgtcctcctgaagcccagcgagcccactgatgcccggcccctgcccgccccagcggcctgtggctccttcactgcctacagctccgacatcctgacagaggatgacgtctactgcagctgcctggccaagacactctgccacgtgccggtccctgtgaccgtgggtttctatgcccctttcggctgccgcctgcacatgatgctggacaagatcacggcgctgatgcagcaggaggccgcgcagcgcgagagcgaggagctgcagcacgtgcagtggcggccgcgtgccgtgagcggctggggcgtcccgcagctactgtggtacctggtgttcctgcagcccatcatcaccgaggtgcacctgcggcgcaggaacgtgcagttccttttcatccgctttagcgcctggcagtacgcgggcaccgacaagctgtgggccggcctggtgaccacgttgtgcgagggcatccgccgccactatggcgcactgcccttcagcgtgtactcggtgctgggcaacaagccggccaccaggcaggactgctgccagagcgagtggcattgtcggcgccgcgtgtgcctggggctgctggcgctgctggcggcgctgggcctgggtgtggggctgctctacttgtcactgggcggccacgcgctgggccacggcagcccgagcggcagcctgctcaaggtgtttggcggcgcggccaccacactgtcgggctcggggctgctcatggccgtgtactcggtgggcaagcacctgttcgtaagccagcgcaagaagatcgagcggctggtgtcgcgtgaaaagttcggcagccagctgggtttcatgtgcgaggtgaagaaggaggtggagctgctcaccgacttcctgtgcttcctggagatctaccagcggcgcaggctgcgcgtggtgctggaggtcaccgggctggacacgtgctacccggagcgcgtggtgggcgtgctcaacgccatcaacacgctgctgtccgacagccacgcgcccttcatcttcatcctggtcgtggaccccagcatcctggccgcgtgcctagagagcgcgggcaacatgaagggcacggccgataacggctacctcttcctcaaccgcactgtcacgctgcccttctctgtgcccattatgggccgccgcaccaagctgcagttcctgcacgatgcggtgcagagccgcgacgacctgttgtaccgcgagatgacgcgcaagccgtggctgccgggggacgccgggggcgagagcgcgcagctgctggcggtgcaggcgcaggcggggacggagcgcgggcagggccgcatcgacgacgaggcggcgcggcgaatccaggaggcgctcttctgccttcacgacgagcgcgactgcctctacgagtacgtgcccgacaacgtggtgtccatgcggcgcatcgtcaacaccgtgcccatcaccgtgcgcctgctgcagcagcagcagcagcagggggactttgggggccccacgccgcgccaggcggtggcgtgggtggtgctcgccaaccagtggccgtgccgcctgagctgggcgctgcagtgcctggaggaccggcagcagaccgggggcgcgcccgagggccgcgcgcgcctctgggacgttttccgcgacaacagccgcgagctgcacaccatgaccaaggcgttgcagaacgtgctcgacctggacggcgaccccgagctcttcgagcgcttcctgggcgccgacttccccttcaccgtggccgaggcgcagagcctgctgcgctgcacggtcaacctggaccactccatccgccggcgcatgggtctcatccgagccgtcagcgcgctcaagccgcccagcccgcccaagtcccctacccgcgataccccccacgctgcccaccgggccaacagcgcctccagggcgcccccgtcgggccgtgcctcagggcaagccggcgaaggccaccacactggggacttggcccacaggggcaagctatggccggtggcctgtgcgctcttccgtccagggcaatccagcccaggtgggccttaaatggaggacttggcgggcagcaggaggcaagggttcctccatctgcccagatgggagaatagggggctggactggggccgcaacccagggtccgaatgagccctgtgaggcccacacccccaggtgaacctgagccagagccgtggacatagcttccaaggagtgcggccacaagccggtgccagcatgagagcaggcacagaaggaccagtgaggaagtcagggtatacatgcaataaatggaggtgttgagagcccggagttgctctccgcatcctgatctgaccagggaccaggcctgccccgtcctgccacagggcctgccccatcctgctaagcccacttactcctctgcaccatgctggcctcctcatctggcatctctgtggcaggagaggctgcgggggtggtgggtgaggctgcagagatgacaggtggatgggccaggttgactcaggcaacatggagcgcccaggcctcagggaatcccagtccttgtccccatgccctagcttgcccctctgtgagtagggcaggggctggcatttctgaggatgacctcggtgacctcagcaagctgctccacccctagggtggctccattctcaacgtaatgggttagacctcgctggcacctcagccagctggagtgggtggcactaacctcccccagacaaataactgtccacagggtacctgccttacgagtcactccagggccactggttagtcactgacactgaagccactgcatcagccccctgatgaggacagggaagttgggcagagatggggacatacagggcccaagccacagccagccaggaggggttacactagggctcccccactttccctctgggcagagccctgggctgggggtgggtgtcactcctctgggcagttcctgattcctcactggtcaaatgttcagccacacgctcaggccctggggtgcctggcccagttccaagtgtgtgccggcaggggccacaagggccaacactgaacataccctgggatgaggctgagggtgtggcttctgagccagggccctgaggctggtggaggggacagcccccgaggaacctgagagctctgcaaaggcacacaccctcaggccatgggactgggtcactgacctcacagttctttagttccaaggctgggcatagcatccaggtctggctgcagcaccggagttctctggccacagcaattgtcacaggtgcatgcaggtcagtgggagccctctatgatcttccctggggctgggcaagcagaggtgctgtttcccattcctggactgactaagctggtaggatacgcctggacctcctgggagctgtttcccagcagtcagggagagctggcctcagagggagaaggatggggcctcgtgacaccgttaagtctgtttctgtagatgtgtggttggggtcaatatatccctgtagcctcccttaagccagtttcagttgggtttgtttcttaccacctggaatccaagctgaaaataaattttcactcctgttaccaggagtggggtgctgtgagagatgctaacgtgtagacttggctggaggtgagggcaggactgaagccccccatgcctcagtaagaagctgcatcagcctggccaacatggtgaagccctgtctctaataaaaatacaaaaagattagctgggcatggtggtgcatgcctgtaatcccagctactcaggaggctgaggtgggaggatcacttgaacccgggaggtggtggctggagccaagatggtgccactgcactccagcctgggcgacagagcaagactccgactgattaaaaaaaaaagccgcagcctctgttacgtggtacaagctgtggccaaactgttggtcactgtatcttcacgtggagctgctatgagaacttgcacctgtgtaaagccacgggaccgttgtcacgaacaaaaaaggagcacggctgacctgtgcgcctttcccagcaatgagtcagggagcaggtttcccttctccactcccttcccccatctgcccacttgatccgggatccttgaggccctggggagcaacagagccctaagagcttcaaaggggcctgggtccaggaataacttggtgaagagctgcctgccactctgaacatccacatgtgacaataaacatctcctgtgttagga

SEQ ID NO: 160290 - DNA, 2080 bp, Homo sapiens
  Payload ID: 11346
  Gene Symbol: NKPD1
  Gene Name: NTPase, KAP family P-loop domain containing 1
  Uniprot ID: Q17RQ9
  ENST ID: ENST00000438936
  CDS Start-End: 213-2045
agcccagcgagcccactgatgcccggcccctgcccgccccagcggcctgtggctccttcactgcctacagctccgacatcctgacagaggatgacgtctactgcagctgcctggccaagacactctgccacgtgccggtccctgtgaccgtgggtttctatgcccctttcggctgccgcctgcacatgatgctggacaagatcacggcgctgatgcagcaggaggccgcgcagcgcgagagcgaggagctgcagcacgtgcagtggcggccgcgtgccgtgagcggctggggcgtcccgcagctactgtggtacctggtgttcctgcagcccatcatcaccgaggtgcacctgcggcgcaggaacgtgcagttccttttcatccgctttagcgcctggcagtacgcgggcaccgacaagctgtgggccggcctggtgaccacgttgtgcgagggcatccgccgccactatggcgcactgcccttcagcgtgtactcggtgctgggcaacaagccggccaccaggcaggactgctgccagagcgagtggcattgtcggcgccgcgtgtgcctggggctgctggcgctgctggcggcgctgggcctgggtgtggggctgctctacttgtcactgggcggccacgcgctgggccacggcagcccgagcggcagcctgctcaaggtgtttggcggcgcggccaccacactgtcgggctcggggctgctcatggccgtgtactcggtgggcaagcacctgttcgtaagccagcgcaagaagatcgagcggctggtgtcgcgtgaaaagttcggcagccagctgggtttcatgtgcgaggtgaagaaggaggtggagctgctcaccgacttcctgtgcttcctggagatctaccagcggcgcaggctgcgcgtggtgctggaggtcaccgggctggacacgtgctacccggagcgcgtggtgggcgtgctcaacgccatcaacacgctgctgtccgacagccacgcgcccttcatcttcatcctggtcgtggaccccagcatcctggccgcgtgcctagagagcgcgggcaacatgaagggcacggccgataacggctacctcttcctcaaccgcactgtcacgctgcccttctctgtgcccattatgggccgccgcaccaagctgcagttcctgcacgatgcggtgcagagccgcgacgacctgttgtaccgcgagatgacgcgcaagccgtggctgccgggggacgccgggggcgagagcgcgcagctgctggcggtgcaggcgcaggcggggacggagcgcgggcagggccgcatcgacgacgaggcggcgcggcgaatccaggaggcgctcttctgccttcacgacgagcgcgactgcctctacgagtacgtgcccgacaacgtggtgtccatgcggcgcatcgtcaacaccgtgcccatcaccgtgcgcctgctgcagcagcagcagcagcagggggactttgggggccccacgccgcgccaggcggtggcgtgggtggtgctcgccaaccagtggccgtgccgcctgagctgggcgctgcagtgcctggaggaccggcagcagaccgggggcgcgcccgagggccgcgcgcgcctctgggacgttttccgcgacaacagccgcgagctgcacaccatgaccaaggcgttgcagaacgtgctcgacctggacggcgaccccgagctcttcgagcgcttcctgggcgccgacttccccttcaccgtggccgaggcgcagagcctgctgcgctgcacggtcaacctggaccactccatccgccggcgcatgggtctcatccgagccgtcagcgcgctcaagccgcccagcccgcccaagtcccctacccgcgataccccccacgctgcccaccgggccaacagcgcctccagggcgcccccgtcgggccgtgcctcagggcaagccggcgaaggccaccacactggggacttggcccacaggggcaagctatggccggtggcctgtgcgctcttccgtccagggcaatccagcccaggtgggccttaaatggaggacttggcgggcagcaggaggcaagggtt

SEQ ID NO: 160291 - DNA, 1950 bp, Homo sapiens
  Payload ID: 11346
  Gene Symbol: NKPD1
  Gene Name: NTPase, KAP family P-loop domain containing 1
  Uniprot ID: Q17RQ9
  ENST ID: ENST00000589776
  CDS Start-End: 83-1915
tccgccctgcccgtactaggccccgcccaccccggcgggtctgcggctcacgcggctcccgggctcccttcccgcagcgctgatgcagcaggaggccgcgcagcgcgagagcgaggagctgcagcacgtgcagtggcggccgcgtgccgtgagcggctggggcgtcccgcagctactgtggtacctggtgttcctgcagcccatcatcaccgaggtgcacctgcggcgcaggaacgtgcagttccttttcatccgctttagcgcctggcagtacgcgggcaccgacaagctgtgggccggcctggtgaccacgttgtgcgagggcatccgccgccactatggcgcactgcccttcagcgtgtactcggtgctgggcaacaagccggccaccaggcaggactgctgccagagcgagtggcattgtcggcgccgcgtgtgcctggggctgctggcgctgctggcggcgctgggcctgggtgtggggctgctctacttgtcactgggcggccacgcgctgggccacggcagcccgagcggcagcctgctcaaggtgtttggcggcgcggccaccacactgtcgggctcggggctgctcatggccgtgtactcggtgggcaagcacctgttcgtaagccagcgcaagaagatcgagcggctggtgtcgcgtgaaaagttcggcagccagctgggtttcatgtgcgaggtgaagaaggaggtggagctgctcaccgacttcctgtgcttcctggagatctaccagcggcgcaggctgcgcgtggtgctggaggtcaccgggctggacacgtgctacccggagcgcgtggtgggcgtgctcaacgccatcaacacgctgctgtccgacagccacgcgcccttcatcttcatcctggtcgtggaccccagcatcctggccgcgtgcctagagagcgcgggcaacatgaagggcacggccgataacggctacctcttcctcaaccgcactgtcacgctgcccttctctgtgcccattatgggccgccgcaccaagctgcagttcctgcacgatgcggtgcagagccgcgacgacctgttgtaccgcgagatgacgcgcaagccgtggctgccgggggacgccgggggcgagagcgcgcagctgctggcggtgcaggcgcaggcggggacggagcgcgggcagggccgcatcgacgacgaggcggcgcggcgaatccaggaggcgctcttctgccttcacgacgagcgcgactgcctctacgagtacgtgcccgacaacgtggtgtccatgcggcgcatcgtcaacaccgtgcccatcaccgtgcgcctgctgcagcagcagcagcagcagggggactttgggggccccacgccgcgccaggcggtggcgtgggtggtgctcgccaaccagtggccgtgccgcctgagctgggcgctgcagtgcctggaggaccggcagcagaccgggggcgcgcccgagggccgcgcgcgcctctgggacgttttccgcgacaacagccgcgagctgcacaccatgaccaaggcgttgcagaacgtgctcgacctggacggcgaccccgagctcttcgagcgcttcctgggcgccgacttccccttcaccgtggccgaggcgcagagcctgctgcgctgcacggtcaacctggaccactccatccgccggcgcatgggtctcatccgagccgtcagcgcgctcaagccgcccagcccgcccaagtcccctacccgcgataccccccacgctgcccaccgggccaacagcgcctccagggcgcccccgtcgggccgtgcctcagggcaagccggcgaaggccaccacactggggacttggcccacaggggcaagctatggccggtggcctgtgcgctcttccgtccagggcaatccagcccaggtgggccttaaatggaggacttggcgggcagcaggaggcaagggtt

SEQ ID NO: 160292 - DNA, 6828 bp, Homo sapiens
  Payload ID: 11347
  Gene Symbol: NUAK1
  Gene Name: NUAK family, SNF1-like kinase, 1
  Uniprot ID: O60285
  ENST ID: ENST00000261402
  CDS Start-End: 1381-3366
aatctcccaaggcctaaggaggcaagaggcctgcaaatcgcctcctgctcagcaaacgggttgctcagcaggcccggggtcctggtccaccccaggtccctggtttgcccacctccgatggcggccttcgctggcagggtgggcgcctctggggagccagctccgtcccggcgcctttagagccccatctcttccacgtccctggccttcctccccttccaggcggctgtccccgccggggtccagatggtgtcggagggccggcggttcgacggcgggcccggggttcagcctcccggcctccctccgtccctgactctcctttcttcggagagggcgcgggggccggggccaaagcgccgctcttggggttctcctggactcggagttgccccaggcgggcgcagctctgccccgcggggtgccagcctcgggcgggcaaggtccgtgagtcaccgcctgtaaccgaacaccaggcctccctgccccctcccccagctccggccgccaggctgcggcgacacctacaagaaaatgaaggggcgcccaggcccgcggcggccccggccgtatcgcgagcaggtcccggcggcccccggctcgcggcgctctttcttccccggccccggggctcggccagccgcaaccgccgccccggcgccagcaggaatccaggccgagcgaccggccccggagcccgaggcggcggagggcccgcggtagctgcgactggcgagcccgagagcgcccggggagggggcgcccggcttggaatttcccggtcccttccggcccagcgaggacaaagcactcctggccgccgccgccgccgccgccgtggcctacgccgcgccgcacaaagggcgagtcgcgacacgctcccatccccctcccagctcacggcggccccggccccgggtggctgcagggaggtgggggaagccctggctgcaccgcccctcgctccccctcccctggggccgcgcgagcgccgcccccgccccgtctgcgcgtcctcccggggaggggttggggggcgcggcgccccacataacactccccctcctgcgctgcgagccaccctctcccctccctcctgcaaacaccaccgcctcccctgccaccgccgccacctcgcccgacgctccacagctcgccgcggccggggggcggtgcgcggaccgtgcgcgccgcgggcgccagatgtgcagtccccgccgccgccagtgaccgagccgcagtccgagcggtatcgggccgcctccctgatgctgcgggggcgaccttgagcgtacagcggcttccctcggtggggaccccgacatcccagcgctgtgcccggtcttgccctctgtagcccggctcgccccgcgcttggacatggaaggggccgccgcgcctgtggcgggggaccgccccgacttggggctgggggcgccgggctctccccgagaggcggtggcgggggcgactgcagccctggagcccaggaagccgcacggggtgaagcggcatcaccacaagcacaacttgaagcaccgctacgagctgcaggagaccctgggcaaaggcacctacggcaaagtcaagcgggccaccgagaggttttctggccgagtggttgctataaaatccattcgtaaggacaaaattaaggatgaacaagacatggttcacatcagacgagagattgagatcatgtcatctctcaaccatcctcatatcatcagtatttatgaagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagatgctcgaggactcatacggtggatgctgatggtgaaccccgatcgccgggccactattgaggacattgccaaccactggtgggtgaactggggctataagagcagcgtgtgtgactgtgatgccctccatgactctgagtccccactcctggctcggatcattgactggcaccaccgttccacagggctgcaggctgacaccgaagccaaaatgaagggcctggccaaacccacgacctctgaggtcatgctagagcggcagcggtcgctgaagaaatccaagaaagagaatgactttgctcagtctggtcaggatgcagtgcctgaaagcccatccaagttgagttctaagaggcccaaggggatcctgaagaagcgaagcaacagcgagcatcgctctcacagcactggcttcattgaaggtgtagttggtcctgccttaccctctactttcaagatggagcaggacttgtgcaggactggcgtgctcctcccaagctcaccagaggcagaggtgccgggaaaactcagccccaagcagtcggccacgatgcccaagaaaggcatcttgaaaaagacccagcagagagaatcaggttactactcttccccagagcgcagtgagtcttcggagctgttggacagtaatgatgtgatgggcagcagcatcccctcccccagccccccggacccagccagggtaacctcccacagcctctcctgccggaggaagggcatcttgaaacacagcagcaaatactcagcgggcaccatggacccagccctggtcagccctgaaatgcccacactggaatccctgtcagagcctggtgtccctgccgagggcctctcccggagctacagccgcccttccagtgtcatcagcgatgacagcgtgctgtccagcgactcttttgacttgctggatttgcaggagaatcgccctgcccgccagcgcatccgcagctgcgtctctgcagaaaacttcctccagatccaggactttgaggggctccagaaccggccccggccccagtacctgaagcggtaccggaaccggctggcagacagcagcttctccctcctcacagacatggatgatgtgactcaggtctacaagcaagcgctggagatctgcagcaagctcaactagcattccagggcgcccaggggcgggcgggggtacgagggaggaaggggagcaagacttgggctcacaggctggttacctctttgctggctgtgacaacagactgaaaaaggattggcactgtctcacttggccaagtttgcagccttgagccaacacctaaaagggagaggtgggctcttctgccagttctgtcaattgtcagtcagaatttgggccctgtttggcatttgctttatggcacctcctagaggaccagctgtccaggggaggtggtattgaccggcactcagtgggtggagaggaagcatatgtggaaggagcatttccttagaagtcatccagatgcttctggaggaggggcaggagacacttgggctgtttgccttgggtgagcccaaagaacttgccccttttctccttgtattagcaagctaggtctggctgcgtggagctggcaagtagatttcagcaacttgagcttgagttgacgatcaattaatagtggctgccagttgtgctggcgtaagtggcccacatcatggggaaggagtgctgtgattgactagtaatggctaccacgggaaagggaaggggaagcagtagcactaatgctatgtagttgtcatctttgatctggctaggccctgggaatcgggtttagtcatcctgtgggatctatgttaactctttcatgccactggtgaggcatttgttaatttgctactcaactttgaggaaagacagggccttggtcagagagagaatgctctgaactctgctaaggacatagagtcagcccatggtgatttagctccttgctgttcacctcctctttcctgatgtctgccttgctctacagcacaacctcttgagggtggacagggagaaagatgatggtgtcagaggtcaaaactattatatatgacagggcacaagatggtctgtgatctttgcacagatgaatggaagttgatgcacaccaacaagaggcaacttgtcactttctttctcaatattaactggaatgctgcctcttgggttctcacctgcatggatgctttgagttggacgtgatactgtccatattctccagaggattacctggctgaaccattggctctgttcaccagtgacagatggtttccccatccactgagtgtagcatcctcagaggtaggcaagtttgcttctagggagttagcatgtagatgggatattgggatgaggaaaggaaaatcaggtagatggtgctttttttcccccaaatctaagtattctatgtcatggttttaaactttgccatgaactcctgggctttgggggaagagaaagttccattcatttaaatgaataaggtgttgaaagagtgcagggggttgggaggaagcatgtaagagagggaacatttccttagatgttacccagatggttctgggggagacagaaaagaggtgcggcaggactcttatcttaaaaagtaaacaaaacaaaacaaaacaaaacaaaaaactagatatgtaatttctaaacacccagatcacaatgacaagatgccactccaaccatgggacaccttcatgatactaggtttgtacttcctggtctctgggatgacttcagattctgctggccaaggcaaattgaactcagttcaagatggccaccactggtagacgtgtagatagaaaagaggactggtcttgggaacatctttggaaaaaccaacaaacaatagttctagggagatgagaaaaaaattcaccttacagtgctaagaaagtgcattagaatggaattgccctttccttaaggagacagtttgggctctccccttgccaccggctctggtgttttggcttatgcgttccttcaggttgagctgagcagtgtgttatgggaagctgctcaatttcctttcattcaattccacctccttcctgaactctaatagaggttaaaagggaaaaaaaaaattctgtagatagcaaattgtgtgtgtgggggggggtgggggtgtgggtgcatggaggacaacctgcaactctgagctccctacttcctgcctcatttcatgcagtcttttctgaacagcctatgctgctgccctgctggccccttgtgcacggcagctggccgtgtccgtagctgtcagtatgacttagatctagctcctacctactggttgatgtgttttttccttttgccaagtgattgagtctgtttagtagtttccatcattctagtctttaagtaaaaatgacactattgaggaaagtcagtctactcccttcttcctccccccaaacacgtgttctcttttgtcaggaaactcagccagtggactgtggcagagaaagtcctccactcagaggcagagactgagttaagtcataggtggccttaggcatctgcattgtttgcaggggttaagttttccttccagtgagggctggagggatgaattagctggtacctgaagccccgcttagctctgacactctgccaacatcctctgattctaggtgtggtgttgactgtcctttcaaggaaaaacttgcaatagagggaaaagccattaaagcagctccctgcttcatcattaagtcctgtcatccctaccagccaatcccagtcaaagaagttatgctttattcacttctgtggaattacaagtgagagacacttttaggacctgatggacaaagcaggagattcactgtcagctttcctggtcctctccttacttctgtgggccttgcaccgtcttagtttacacatctgccaaaggggtagaattacacttctttttacaggtaaatgtcaaggcacaatcagttttcaggaagtgcttcaagaccccaggtgaaatgaaaatgctaagtaccctctgaatggccatgcctgttaccaggtgctgcttcttcagatgatggggagcacttttcagggtgaaattcaggcgagttttgcccaggcctgctgtcttgagtacaaatgtgaatgatcgactgactgcttgttgccaaactggaaatgttctgtagggatttactggcatggtatcattcctagaagaaaaaaagagagaaacttgactgcacattaaaaaaaaaaaaaaatccacattgtgacttttatttaatttctattttttttggtaataaaaagttgacttttttatttgaatttgtcttttttatttattggtctgaaaggcatttcaaaggtattataataatatattggtgtaatttaattggtgcaacatgctttatggctcctgtcaaaattggttttcactcatttgattggtttgagcccagaacagcctacaggggaaaaacaagctggataaccacccaaagtgtttgtattttcgttggaaactgatttttgtttcattttggtttttgtttctgtttttatttttaaattaaataaattgcaatgaactgaaccaga

SEQ ID NO: 160293 - DNA, 547 bp, Homo sapiens
  Payload ID: 11347
  Gene Symbol: NUAK1
  Gene Name: NUAK family, SNF1-like kinase, 1
  ENST ID: ENST00000553094
  CDS Start-End: 194-547
aatctgtcagacatttccctttgctcaccctcctccttcctctttctctcttgttctcatcccagccgctcccattcaattccctctttgtcttctcatttcagaacggtgtggtccaccgggacttgaagctggaaaatatactgctcgatgacaactgcaatattaagatgctcgaggactcatacggtggatgctgatggtgaaccccgatcgccgggccactattgaggacattgccaaccactggtgggtgaactggggctataagagcagcgtgtgtgactgtgatgccctccatgactctgagtccccactcctggctcggatcattgactggcaccaccgttccacagggctgcaggctgacaccgaagccaaaatgaagggcctggccaaacccacgacctctgaggtcatgctagagcggcagcggtcgctgaagaaatccaagaaagagaatgactttgctcagtctggtcaggatgcagtgcctgaaagcccatccaagttgagttctaagaggcccaaggggatcctgaagaag

SEQ ID NO: 160294 - DNA, 560 bp, Homo sapiens
  Payload ID: 11347
  Gene Symbol: NUAK1
  Gene Name: NUAK family, SNF1-like kinase, 1
  ENST ID: ENST00000548902
  CDS Start-End: 104-560
gcattctctgtagcataagtgagcttgttggctaaacggggtgtttgtgtattgctgttttccctctgcagtgtttgagaacaaagataagattgtgatcatcatggaatatgccagcaaaggggagctgtacgattacatcagtgagcggcgacgcctcagtgagagggagacccggcacttcttccggcagatcgtctctgctgtgcactattgtcacaagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagatgctcgaggactcatac

SEQ ID NO: 160295 - DNA, 569 bp, Homo sapiens
  Payload ID: 11347
  Gene Symbol: NUAK1
  Gene Name: NUAK family, SNF1-like kinase, 1
  ENST ID: ENST00000549704
  CDS Start-End: 347-569
tctttaatctgtcagacatttccctttgctcaccctcctccttcctctttctctcttgttctcatcccagccgctcccattcaattccctctttgtcttctcatttcagaacggtgtggtccaccgggacttgaagctggaaaatatactgctcgatgacaactgcaatattaagattgctgactttgggctttccaacctgtaccagaaggataagttcttacaaacgttttgtgggagtccactctatgcatctcctgagattgtcaatgggagaccttaccgagggccagaggtggacagctgggccctgggtgtgttgctttacactcttgtttatggaacaatgcccttcgatggtttcgatcacaaaaacctcattcggcaaatcagcagcggagagtaccgggagccaacacagccctcagatgctcgaggactcatacggtggatgctgatggtgaaccccgatcgccgggccactattgaggacattgccaaccactggtgggtgaactggggctataagagcagcgtgtgtgactgtgatgccctccatgactctgagt

SEQ ID NO: 160296 - DNA, 3441 bp, Homo sapiens
  Payload ID: 11348
  Gene Symbol: NUAK2
  Gene Name: NUAK family, SNF1-like kinase, 2
  Uniprot ID: Q9H093
  ENST ID: ENST00000367157
  CDS Start-End: 32-2050
ctcgggctcagggcgtttataacaacttggaatgctgtgctttactgcgcgctctggtactgctgtggctccccgtcctggtgcgggacctgtgccccgcgcttcagccctccccgcacagcctactgattcccctgccgcccttgctcacctcctgctcgccatggagtcgctggttttcgcgcggcgctccggccccactccctcggccgcagagctagcccggccgctggcggaagggctgatcaagtcgcccaagcccctaatgaagaagcaggcggtgaagcggcaccaccacaagcacaacctgcggcaccgctacgagttcctggagaccctgggcaaaggcacctacgggaaggtgaagaaggcgcgggagagctcggggcgcctggtggccatcaagtcaatccggaaggacaaaatcaaagatgagcaagatctgatgcacatacggagggagattgagatcatgtcatcactcaaccaccctcacatcattgccatccatgaagtgtttgagaacagcagcaagatcgtgatcgtcatggagtatgccagccggggcgacctttatgactacatcagcgagcggcagcagctcagtgagcgcgaagctaggcatttcttccggcagatcgtctctgccgtgcactattgccatcagaacagagttgtccaccgagatctcaagctggagaacatcctcttggatgccaatgggaatatcaagattgctgacttcggtctctccaacctctaccatcaaggcaagttcctgcagacattctgtgggagccccctctatgcctcgccagagattgtcaatgggaagccctacacaggcccagaggtggacagctggtccctgggtgttctcctctacatcctggtgcatggcaccatgccctttgatgggcatgaccataagatcctagtgaaacagatcagcaacggggcctaccgggagccacctaaaccctctgatgcctgtggcctgatccggtggctgttgatggtgaaccccacccgccgggccaccctggaggatgtggccagtcactggtgggtcaactggggctacgccacccgagtgggagagcaggaggctccgcatgagggtgggcaccctggcagtgactctgcccgcgcctccatggctgactggctccggcgttcctcccgccccctcctggagaatggggccaaggtgtgcagcttcttcaagcagcatgcacctggtgggggaagcaccacccctggcctggagcgccagcattcgctcaagaagtcccgcaaggagaatgacatggcccagtctctccacagtgacacggctgatgacactgcccatcgccctggcaagagcaacctcaagctgccaaagggcattctcaagaagaaggtgtcagcctctgcagaaggggtacaggaggaccctccggagctcagcccaatccctgcgagcccagggcaggctgcccccctgctccccaagaagggcattctcaagaagccccgacagcgcgagtctggctactactcctctcccgagcccagtgaatctggggagctcttggacgcaggcgacgtgtttgtgagtggggatcccaaggagcagaagcctccgcaagcttcagggctgctcctccatcgcaaaggcatcctcaaactcaatggcaagttctcccagacagccttggagctcgcggcccccaccaccttcggctccctggatgaactcgccccacctcgccccctggcccgggccagccgaccctcaggggctgtgagcgaggacagcatcctgtcctctgagtcctttgaccagctggacttgcctgaacggctcccagagcccccactgcggggctgtgtgtctgtggacaacctcacggggcttgaggagcccccctcagagggccctggaagctgcctgaggcgctggcggcaggatcctttgggggacagctgcttttccctgacagactgccaggaggtgacagcgacctaccgacaggcactgagggtctgctcaaagctcacctgagtggagtaggcattgccccagcccggtcaggctctcagatgcagctggttgcaccccgaggggagatgccttctcccccacctcccaggacctgcatcccagctcagaaggctgagagggtttgcagtggagccctgagcagggctggatatgggaagtaggcaaatgaaatgcgccaagggttcagtgtctgtcttcagccctgctgaacgaagaggatactaaagagaggggaacgggaatgcccgcgacagagtccacattgcctgtttcttgtgtacatgggggggccacagagacctggaaagagaactctcccagggcccatctcctgcatcccatgaatactctgtacacatggtgccttctaaggacagctccttccctactcattccctgcccaagtggggccagacctctttacacacacattcccgttcctaccaaccaccagaactggatggtggcacccctaatgtgcatgaggcatcctgggaatggtctggagtaacgcttcgttatttttatttttatttttatttatttatttatttttttgagacggagtttcgctcttggtgcccaggctagagtgcaatggcgcgatctcagctcacctcaacctccgcctcccgggttcaagcgattctcctgcctcagcctccctagtagctgggattacaggcgcccgccaccatgcccggctaattttgtatttttagtagagacagggtttctccatgttggtcaggctggtctcaaactcccgacctcaggtgatccacccacctcggcctcccaaagtgctgggattacaggcgtgagccaccgcgccccacctaacccttccttatttagcctaggagtaagagaacacaatctctgtttcttcaatggttctcttcccttttccatcctccaaacctggcctgagcctcctgaagttgctgctgtgaatctgaaagacttgaaaagcctccgcctgctgtgtggacttcatctcaaggggcccagcctcctctggactccaccttggacctcagtgactcagaacttctgcctctaagctgctctaaagtccagactatggatgtgttctctaggccttcaggactctagaatgtccatatttatttttatgttcttggctttgtgttttaggaaaagtgaatcttgctgttttcaataatgtgaatgctatgttctgggaaaatccactatgacatctaagttttgtgtacagagagatatttttgcaactatttccacctcctcccacaaccccccacactccactccacactcttgagtctctttacctaatggtctctacctaatggacctccgtggccaaaaagtaccattaaaaccagaaaggtgattggaagcag

SEQ ID NO: 160297 - DNA, 3399 bp, Homo sapiens
  Payload ID: 11349
  Gene Symbol: NAIF1
  Gene Name: nuclear apoptosis inducing factor 1
  Uniprot ID: Q69YI7
  ENST ID: ENST00000373078
  CDS Start-End: 221-1204
cattacgctgctggctggcagcggccgggccggtcggggctgggccctacgcactttgcgtagcgaggggggttaccaaaggcctagtgcttggcctcgagcaagcctggcctatcccctgtagggggtgggtgaggggcgaggctgaggaagaagagaaggggaattggggcgcttgaggggattataatttctttaaaaagaggggaggggagaggccatggccgtcccagccaagaaaaggaagatgaacttctcagagcgggaggtggagatcatcgtggaggagctggagctgaagaagcacctgctggtgaaccacttcaacgccggggtacccctggccgccaagagtgcggcctggcacggcatcctgagaagggtcaacgccgtggccacctgccgcagagagctgcctgaggtcaagaagaagtggtctgacctcaagaccgaggtccgtcgcaaggttgcccaggtccgggccgccgtggagggtggtgaggcgccggggcccactgaggaggacggagctggggggcctgggacaggcggtggcagtggtggcggtggcccagctgtagccccagtgctgctgacccccatgcaacaacgtatctgcaacctgctgggcgaggccaccatcatcagcctgcccagcaccacagagatccaccctgtggccctcggaccctcggccaccgcagccgcagccacggtcaccctgacacagatccccacagagaccacctatcacacgctggaggagggcgtggtggagtactgcacggctgaggcgcccccacctctgccaccagagacccctgtggacatgatggcccagcatgcagacacgtcggtcaagccgcaagcgctcaagagccgcattgctctcaactccgccaagctgatacaggagcagcgggtcaccaacctgcatgtgaaggagatcgcacagcacctggaacagcagaacgacctactgcagatgatccgccgctcccaggaagtgcaggcctgtgcccaggagcgccaggcccaggccatggagggcacacaggctgccctgagcgtcctcatccaggtcctccggcctatgatcaaagatttccgccgctacctgcagagcaacacagctaacccggcccccgcctctgaccctgggcaggtggcccagaatgggcagccagacagcatcatccagtgagggcaggggtcaggccagccttctgccatgatgggatgaaaactccatggacttgtaagtgggtcctgtgattggccttggccttagaccggccacgtgcacagctccctctttaataaacgcttaggggttgcactgtttttgagaagaggaatttgttgggctcctgggacccaaactcatactccccctacttgagctgccttgctaagatccagaagattggttagcagggggtcacgtgtgcatgtgatgggacatgtgttgtcatgaccccgggcttgtgacatgacccagccttggtcttggacaactgtaaggaacaacacaacgggctgtcactgggggccgtcacccagcctgggtctctactgagctgcccaaccccaggtgccatcctttcgagtagggtaatgtcactgatgctggcagttgagcaataatatcttcctcctttgggaggtagtgtgactgaggaggaaaccccacccttttctcctcactgtgcctcagttctcaggggactccaatgactgttgtgctctcccccgaccccaccccaggcacagcgcaggcccttgttaggtagtgtgctgggacgcctccgtaatacatgcagtgtgcagccagtctggctcaggaatgctgtgtatggtggggacggtttggccactctctggttttcaacagcatctctgggcagccctttggtggtttgtccctagagcttttgactcaggtcaagctttggatgctgtaaatttttgagaaagccaactagtgtggaagcttgctgccccactgcagtgggtctgagtgacctgttggctttgtgcggaggcttgcatccagccagttgtatttattctgtgtgtgaacccctcctaggaaggcctccaggaaggctgccctgtggccacacccatcctcctttcctctctgctgactccacatttccaaaattcagtgcaaaaaaagccctgctgagcatcacatgctggactcttcccctgccacaccgctcagtgccttctgttctcttgagactccctctgagtagctgagtgaatccaaagccataattgaccctgaacgtaggaggaggaaaaggcgaagctgacctaagaagtgggaccctggccgggcgaggtggctcaagtctgtaatcccagcgctttgggaggccgaggcgggtggatcacgaggtcaagagatcaagaccatcctggccaacatgatgaaaccccgtctctactaaaaacacaaaaattagctgggcgtggtggcacacgcctgtagtcccagctacccgggaggctgaggcaggagaatcgcttgaacccaggaggcggagattgcagtgagccgagattgcaccgctgcactccagcctggcgacagagcgagactctgtctcaaaaaaaaaacaaagaaaaaaccaaaaaaacaaatgggaccctttggattctatgctcagggaagagcaggcagagccttggagtgctgaaggaggtgctgttccctgttccatctttacactttctcttctgagatgtctgtaaggattttacccagatgccatttgtctgtttcattttcagactcaccatcaattaccaaggcccttgcatctccccagatcgtttcccaagtttggcgatttgctgtcggtgcctcagccacatatgaccaatggttacaactcagggctccagacctcagctaaaaagagaagacgctgccctcctgggcacgaacgtttagaatgctcaactcctctattgtgaccacaggaaggtggccctgaagatgcaccgaagacagctgggaggtgactgctgtactgtcagcctctctgtggaggcattcgtgcagtgccagctaaaagggaggtgaagggggatatcggacccagcgagggagttgctggtagaaggaaagctcttctcagtgtggctggattaagagcagcctagcagcttgggcacctccactctgtgcggtctgatggccccagcaaggtcgctgcagggacttcctgaggacttggtttggtttttttctggggttggaaatctgagccaatattgtgtctgttccatttgggtatgaagaggaagtctggatcacttaaactgactagttatttccgggtcataattttaaattaaagacatatcacttttttatacaca

SEQ ID NO: 160298 - DNA, 1907 bp, Homo sapiens
  Payload ID: 11350
  Gene Symbol: NAF1
  Gene Name: nuclear assembly factor 1 ribonucleoprotein
  Uniprot ID: Q96HR8
  ENST ID: ENST00000274054
  CDS Start-End: 195-1679
cggaaagcgttgctgcgtaaatggcgggggcgtgtcttttggctcctccgcgtgtagttacctgagaaacgcgggaagttgggcccaggcagtgttgctgcggttgcctaagttgtttttctatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagaggccttagattttagtgatgatgaaaaagagaaggaagccaaacagaggaaaaaatctcagattcaaggccggaaaaaactcaaatctgaatttaatgagcctggtgaagattttactgaagtacatcagaattggaatgctcatagctctgcttcagagcatgcaaaaggatatcgtaacagagaattcacacgaggattttccagggccagataccctcgatcttgccatggcaggcctccacctcagcatttctataactcagaacatatggtatctcaggagacttcaggatttccttctcagagacaaaataatcccattatgccacaatacccctttcctcttccagtgtttgacatgcataattttcccctccgccctccacccccaccaccacccccacctgtaaacatgggttgggctacaccaaacatggctgctcatccattacttaacttaccatactccctacccccaccccctccccctccaccactgcctcctccaccctcttctggagatagtaattctcattttggaccttactattaggtgactatgcatttccagagaaatgtggacttttcatattatgtggtaaggatttttttttttcaagagtgattatggagctagatttttaaaaacactgtaaaatactaaatgattccttctgttgtaagttgatatatatttgtaacctttgtgaaattgtattcatatgaaaatgtcagctcaaattcttgggagaacattaaattatgtaatatttaattaaaa

SEQ ID NO: 160299 - DNA, 1604 bp, Homo sapiens
  Payload ID: 11350
  Gene Symbol: NAF1
  Gene Name: nuclear assembly factor 1 ribonucleoprotein
  Uniprot ID: Q96HR8
  ENST ID: ENST00000422287
  CDS Start-End: 164-1333
gtgtcttttggctcctccgcgtgtagttacctgagaaacgcgggaagttgggcccaggcagtgttgctgcggttgcctaagttgtttttctatttctggagagagccgtgagcttgtccaggggccccaatcctgaggccgacccggtttctggcgcggtgcgatggaggtagtggaggccgccgccgctcagctggaaactctgaaattcaatggcaccgactttggagttggggaaggtccggcggctccgtctccgggctctgcccctgtgccagggacacagccgccgctacagtcgtttgaggggtccccggacgctgggcagaccgtggaggttaagcctgccggggagcagcctctgcagcccgttctgaacgccgtcgcggccgggaccccggcgccgcagccacagccaccggctgaatcgccggcctgcggagactgcgtcacctccccaggagccgcagagcctgcgcgggcgccggactccttggagacctcggactcggattcggactcggacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatgaactgccttctgttgaagaactcactattattctgcctgaagatattgagttaaagcctcttgggatggtttcaagtattattgaacaactagtaataattgaatctatgactaacctacctccagttaatgaggagactgtaatttttaaaagtgatcgacaagcagcaggaaagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagaggccttagattttagtgatgatgaaaaagagaaggaagccaaacagaggaaaaaatctcagattcaaggccggaaaaaactcaaatctgaatttaatgagcctggtacaggtatatctcacagatattgtggcctcggatccagaccattgcagtcaagtgagtcacacaaactttttggtttccaaatgcatataaaagttacgtttacatgctactttagtttattaagtatgcaatagcattgtgtctaaaaaaaccaatgtgcatatctcaattggagaatactttactgttcaaaaaataataatgaccctttgagcctgcagtgagttacagtcttttagctgttggaaggtctggactcaagtgctgttggccgctgactaatcagggtagttgttgctaaaagtggcagtttctcctaatagatagcagtgaagtgtgctacattaattggctcttcctttcaccaaagatttctgtgtagcatgtgatgctacttgatagcat

SEQ ID NO: 160300 - DNA, 385 bp, Homo sapiens
  Payload ID: 11350
  Gene Symbol: NAF1
  Gene Name: nuclear assembly factor 1 ribonucleoprotein
  ENST ID: ENST00000509434
  CDS Start-End: 54-182
ggtttaattcttcagatcacattgagagtaaaggtattaaaataaaggagactatgtattttgctccatcaatgaaagatttcactcaatatatattcacagaaaaactaaaacaggataagggatcagatgcatcatggaagaatgatcaggaaccaccaccagagaccatggttgactgaaggtaactgaaaccacgaaaagtgacagcacagatgaggggagagtactgtatcctcaaatgatggtatggctggtgatggtaacagcaagtctaccagcctagtcaagcattcttatccatagaagagttgccatgggaacctcatggcaacccacagatttcaagtactgtatgttctgcctaaataaataatgaaaagct

SEQ ID NO: 160301 - DNA, 3207 bp, Homo sapiens
  Payload ID: 11351
  Gene Symbol: NASP
  Gene Name: nuclear autoantigenic sperm protein (histone-binding)
  Uniprot ID: P49321
  ENST ID: ENST00000350030
  CDS Start-End: 88-2454
gtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatct

SEQ ID NO: 160302 - DNA, 1538 bp, Homo sapiens
  Payload ID: 11351
  Gene Symbol: NASP
  Gene Name: nuclear autoantigenic sperm protein (histone-binding)
  Uniprot ID: P49321
  ENST ID: ENST00000351223
  CDS Start-End: 83-1432
tgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 160303 - DNA, 1458 bp, Homo sapiens
  Payload ID: 11351
  Gene Symbol: NASP
  Gene Name: nuclear autoantigenic sperm protein (histone-binding)
  ENST ID: ENST00000372052
  CDS Start-End: 85-1353
cctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaatggagaatggtgtgttgggaaacgccttggaaggtgtgcatgtggaagaggaagaaggagaaaaaacagaagatgaatctctggtagaaaataatgataacatagatgaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaa

SEQ ID NO: 160304 - DNA, 999 bp, Homo sapiens
  Payload ID: 11351
  Gene Symbol: NASP
  Gene Name: nuclear autoantigenic sperm protein (histone-binding)
  ENST ID: ENST00000437362
  CDS Start-End: 159-275
atgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagcaaccattaatctgctttctgtcactgaagatgggttgcattttgtagaatattatctaaatagaatcatacatctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatggg

SEQ ID NO: 160305 - DNA, 874 bp, Homo sapiens
  Payload ID: 11351
  Gene Symbol: NASP
  Gene Name: nuclear autoantigenic sperm protein (histone-binding)
  ENST ID: ENST00000437901
  CDS Start-End: 107-874
agtcgggctagggagggaaacaatcccgcggagccatatggagagggcaggaggtgtctagatagtggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatggg

SEQ ID NO: 160306 - DNA, 2080 bp, Homo sapiens
  Payload ID: 11351
  Gene Symbol: NASP
  Gene Name: nuclear autoantigenic sperm protein (histone-binding)
  ENST ID: ENST00000453748
  CDS Start-End: 103-219
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagcaaccattaatctgctttctgtcactgaagatgggttgcattttgtagaatattatctaaatagaatcatacatctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatac

SEQ ID NO: 160307 - DNA, 894 bp, Homo sapiens
  Payload ID: 11351
  Gene Symbol: NASP
  Gene Name: nuclear autoantigenic sperm protein (histone-binding)
  ENST ID: ENST00000528238
  CDS Start-End: 90-894
ctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaatggagaatggtgtgttgggaaacgccttggaaggtgtgcatgtggaagaggaagaaggagaaaaaacagaagatgaatctctggtagaaaataatgataacatagatgaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaag

SEQ ID NO: 160308 - DNA, 632 bp, Homo sapiens
  Payload ID: 11351
  Gene Symbol: NASP
  Gene Name: nuclear autoantigenic sperm protein (histone-binding)
  ENST ID: ENST00000534450
  CDS Start-End: 1-526
gcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaa

SEQ ID NO: 160309 - DNA, 535 bp, Homo sapiens
  Payload ID: 11351
  Gene Symbol: NASP
  Gene Name: nuclear autoantigenic sperm protein (histone-binding)
  ENST ID: ENST00000528084
  CDS Start-End: 106-276
tctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagagatgaggtttcgtcacgttgcccaggctggggctcaagccatcttctcacctcagccacctgaagtgctgggattacagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaaga

SEQ ID NO: 160310 - DNA, 531 bp, Homo sapiens
  Payload ID: 11351
  Gene Symbol: NASP
  Gene Name: nuclear autoantigenic sperm protein (histone-binding)
  ENST ID: ENST00000530840
  CDS Start-End: 103-270
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaatgagcggccgggcgcggtggctcacacctgtaatccagcactttgggaggccgaggtgggcagatcacgaggtcaggagatcgagaccatcctggctaacacggtgaaaccccatctctactaaaaatacaaaaaaaaaatgtagtcccagctacttgagaagctgacgcaggagaatggcgtgaacccgggaggcggagcttgcagtgagccgagatcgagatcgcgccactgcactccagcctgggcaacagtgcgagactccgtctcaaaaacaaaagaatgagcagtagcagaattgaagatgttcctgctccttctacatctgcagataaagtggagagtctggatgtggatagtgaagctaa

SEQ ID NO: 160311 - DNA, 778 bp, Homo sapiens
  Payload ID: 11351
  Gene Symbol: NASP
  Gene Name: nuclear autoantigenic sperm protein (histone-binding)
  ENST ID: ENST00000529333
  CDS Start-End: 103-219
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagcaaccattaatctgctttctgtcactgaagatgggttgcattttgtagaatattatctaaatagaatcatacatctggatgtggatagtgaagctaagaaactattgggtttaggacagaaacatctggtgatgggggatattccagcagctgtcaatgcattccaggaagcagctagtcttttatgtttattctctttgtagaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagcc

SEQ ID NO: 160312 - DNA, 554 bp, Homo sapiens
  Payload ID: 11351
  Gene Symbol: NASP
  Gene Name: nuclear autoantigenic sperm protein (histone-binding)
  ENST ID: ENST00000531532
  CDS Start-End: 103-273
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagagatgaggtttcgtcacgttgcccaggctggggctcaagccatcttctcacctcagccacctgaagtgctgggattacagcaaccattaatctgctttctgtcactgaagatgggttgcattttgtagaatattatctaaatagaatcatacatctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaag

SEQ ID NO: 160313 - DNA, 743 bp, Homo sapiens
  Payload ID: 11351
  Gene Symbol: NASP
  Gene Name: nuclear autoantigenic sperm protein (histone-binding)
  ENST ID: ENST00000527359
  CDS Start-End: 106-219
tctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaaga

SEQ ID NO: 160314 - DNA, 1036 bp, Homo sapiens
  Payload ID: 11351
  Gene Symbol: NASP
  Gene Name: nuclear autoantigenic sperm protein (histone-binding)
  ENST ID: ENST00000470768
  CDS Start-End: 87-1036
tccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggc

SEQ ID NO: 160315 - DNA, 565 bp, Homo sapiens
  Payload ID: 11351
  Gene Symbol: NASP
  Gene Name: nuclear autoantigenic sperm protein (histone-binding)
  ENST ID: ENST00000525515
  CDS Start-End: 103-565
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaatctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcagaagaggatgataaagaaaatgataagaccgaagaaatgccaaatgattcagtccttgaaaacaagtctcttcaagaaaatgaggagg

SEQ ID NO: 160316 - DNA, 938 bp, Homo sapiens
  Payload ID: 11351
  Gene Symbol: NASP
  Gene Name: nuclear autoantigenic sperm protein (histone-binding)
  ENST ID: ENST00000531612
  CDS Start-End: 1-866
aaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattc

SEQ ID NO: 160317 - DNA, 532 bp, Homo sapiens
  Payload ID: 11351
  Gene Symbol: NASP
  Gene Name: nuclear autoantigenic sperm protein (histone-binding)
  ENST ID: ENST00000527470
  CDS Start-End: 103-532
aatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactg

SEQ ID NO: 160318 - DNA, 3097 bp, Homo sapiens
  Payload ID: 11351
  Gene Symbol: NASP
  Gene Name: nuclear autoantigenic sperm protein (histone-binding)
  Uniprot ID: P49321
  ENST ID: ENST00000537798
  CDS Start-End: 160-2334
gatgggcggggcgaagggtcctcgtatataaaagggccccggccgcgcggggtctctaatctgccattttctgtccctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgacaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcagaagaggatgataaagaaaatgataagaccgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaagagggggcacagccctcctcccaagggaaagtgtttttgtatataatgtattttttcacttttggaggattctttttgtataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatctccttgtctgg

SEQ ID NO: 160319 - DNA, 253 bp, Homo sapiens
  Payload ID: 11351
  Gene Symbol: NASP
  Gene Name: nuclear autoantigenic sperm protein (histone-binding)
  ENST ID: ENST00000629893
  CDS Start-End: 83-253
tgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagagatgaggtttcgtcacgttgcccaggctggggctcaagccatcttctcacctcagccacctga

SEQ ID NO: 160320 - DNA, 728 bp, Homo sapiens
  Payload ID: 11352
  Gene Symbol: NCBP1
  Gene Name: nuclear cap binding protein subunit 1, 80kDa
  ENST ID: ENST00000375130
  CDS Start-End: 1-466
attgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacaggtatgtggggaacttcgattaggtaataacactattctcagccacaaagatttttcattaaaaaaaatccttgtcaaatttgttaggaggttatatagtacctgttagaccctttagttcatgtccatttgctgctaccattgctcatcagaatatttaggcttaaactgattctgtaccacttagattcctaattgccacccccccaacaaccccccgccccaccttttttttgagatggcatctcactctgttgcccaggctggagttcagtgacacgatctcagctcactgcaacctccacctcctaggtttaagcaattcttctgcctcagcctcccatattgctgggattacaggcacccgtcac

SEQ ID NO: 160321 - DNA, 5178 bp, Homo sapiens
  Payload ID: 11352
  Gene Symbol: NCBP1
  Gene Name: nuclear cap binding protein subunit 1, 80kDa
  Uniprot ID: Q09161
  ENST ID: ENST00000375147
  CDS Start-End: 257-2629
ggcggaggcagcccgagggggcggttgcatgtgtgccagacgttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagttgcacgcctattacctgagaagctgacaatttatacaacattagttggactactgaatgccaggaattacaattttggtggagaatttgtagaagccatgattcgtcaacttaaagaatcattgaaagcaaacaattataatgaagccgtgtatttggtccgttttttatctgatcttgtgaattgtcatgtgattgccgccccatcaatggttgctatgtttgaaaattttgtaagcgtaactcaggaagaagatgtacctcaggtgcgacgagattggtatgtgtatgcatttctgtcatctttgccctgggttggaaaggagttgtacgaaaagaaagatgcagagatggaccgcatctttgccaacactgaaagctatcttaaaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcactgcatcattaagtcccactggaaggaaaggaagacttgtgctgcacagttagtgagctatccagggaagaacaagatccccttgaactaccacatagttgaggtgatctttgcagagctgtttcaacttccagcaccccctcacattgatgtgatgtacacaacactcctcattgaactgtgcaaacttcaacctggctctctaccccaagttcttgcacaggcaactgaaatgctatacatgcgtttggacacaatgaacactacctgtgtagacaggtttattaattggttttctcatcatctaagtaacttccagttccgttggagctgggaagattggtcagattgtcttagtcaagatcctgaaagtcccaaaccgaagtttgtaagagaagttctagaaaaatgtatgaggttgtcttaccatcagcgtatattagatattgttcctcctaccttctcagctctgtgtcctgcaaacccaacctgcatttacaagtatggagatgaaagtagcaattctcttcctggacattctgttgccctctgtttagctgttgcctttaaaagtaaggcaaccaatgatgaaatcttcagcattctgaaagatgtaccaaatcctaaccaggatgatgacgacgatgaaggattcagttttaacccattgaaaatagaagtctttgtacagactctgctacacttggcagccaaatcattcagccactccttcagtgctcttgcaaagtttcatgaagtcttcaaaaccctagctgaaagtgatgaaggaaagttacatgtgctaagagttatgtttgaggtctggaggaaccatccacagatgattgctgtactagtggataagatgattcgtacacaaatagttgattgtgctgccgtagcaaattggatcttctcttcagaactatctcgtgactttaccagattgtttgtttgggaaattttgcactctacaattcgtaagatgaacaaacatgtcctgaagatccagaaagagctggaagaagctaaagagaaacttgctaggcaacacaaacggcgaagtgatgatgacgacagaagcagtgacaggaaagacggggttcttgaggaacaaatagaacgacttcaggaaaaagtggaatctgctcagagtgaacaaaagaatcttttcctcgttatatttcagcggtttatcatgatcttgaccgagcacctagtacgatgcgaaactgatgggaccagtgtattaacaccatggtataagaactgtatagagaggctgcagcagatcttcctacagcatcaccaaataatccagcagtacatggtgaccctggagaaccttctcttcactgctgaattagaccctcatatcttggccgtgttccagcagttctgtgccctgcaggcctaagggtcattttttcctcatgtcaaggttttttttgatatcttaaaataatttgtcttattttttgatggtttgaatgcttgctttcttgtagtatcctttcacttcttaaaggaaacaaaggggaagaggacagtgaatgaacatggcattacttttaattgccctgaaaagcaaatacttcctaacggcagtaatgtgactatgaccatgatatattatatatgtgacagatacaaattctctgtgatcagtttgttattttttttctccttaaggcacaaaataattggtttgaggtatgtgaaacactagaggtcaaccttacatagtatatagaactgatgggtttacccagctacccagtagcataacttttcacagctcggggatgaattaacatggctgaaataaaactaaaagtatggtttttaaactttggcatttcatgatttatcatctcactctactctaaaactggtggtttcttactgaaggtgttctccatttgaaattttatcttcaaagtatttttaagtagtatctttaagacatgacttgttagtaataaaagtgttactagttggaagagtagctctcaaatttgtcttaatgtaaatcacctgggaatctttcaagttattttgaaatttaaaccaccgtctgggggtggaacgcagacatcctcagtaatccttaaagtttccccaggtgattccaggtttggtcaccattatcttagagcatctactcacttcctctagccttggggttatttgtccaaggtcttgtagtgagttacagaatactaaagtggatgtagaagtggtcagattgactgaaactataccctgaattagatgtgagtttagattttgtttatatggaacctgatccaaaaaactacgaagtcctgagcttgtttcctgtatagtactgatgctgaaataagatgacagcagtttgtaaaataatacacaaatatgaggaattgtctgacattccaaatttcgaggatttttagacttttttcattaaaccttagaaaaaaattaccagtaatcctacaactactggtagtgttgttgtgcatttgcacaaaataggtataattttttcttattacatcccaagtttatgatgcattaagcgttttgcatattttgatatatttttgctttggtttaccatacattttagtggctacagaatgtagtctgcttaataaatgggaattcctagaatgtttaaataccatactatttaagacaaaatacaaaatatccagaaaaatccaggttgcgtggctggttagtaaaggactaaaacccaggttcttggctaaatgttttcgtttatactgtttatctttcccattgcttaagcacagcacaaactatgtaattatatataattacagttgacccttgaacaacatgggtttgaactgtgtgagtctccttacacacaggttttcttccacccctgagatggcaagaccagccccttgtcttcctcagcctgctcaacgtgaagatgatgaggatgaagacctttatgatgatccacttctacttattaaatagtaaatatatttttttcttatgattttattttcttttctctagcttcataagaatatagcatatgggctgggcgcagtggctcacgcctgtaatcccagcactttgggaggctgaggcgggcggatcacaaggtcaggagattgagaccatcctggctaacacagtgaaaccctgtctctactaaaaacacaaaaacttagccaggcgtggtggtacatggctgtagtcccagctacttgggaggctgagacaggagaatcgcttgaacctgggaggtggaggtttcagtgagccaagattgtgccactgcactccagcctgggtgatggagcgaggctctgtctcaaaaaagaaaaaaaatatatagcatataacatacaaaatgagtttatcaactgtttgttattggtaagtcagcagtgggctattggtggttaagttttgggggagtcaaaagttacatgcaaattttttactgtgcggggtgtcagcatccctaaccccatgttgttcaagggtcaactgtagtttaaaatgactcctgtctcaaaaaaccaaaggataacctttaagggattggtaactttgactcaaaactgctttgtaatcttttcacaatgtactgaaaagtgtggctagttatgtttgatccacattctagagaaatttgtaggttttaatttcttttctcttggtcctctcttcatgtataatggttgcttttaacagctgttcgctgatgtggtcctgctctgtcccagtctagcagctttagtgtatggaaaaattgaactaggaattgagttttgaagaaataaaggtgtaagagcaaacattcaacagttgctgtccccagtaatgaagttcatacagacaaaagatggcatgtcactgtacatcataccttgcaataaatattctgttaaattgtgctggtgcaatttaacatgcttttgtcaaagtaaa

SEQ ID NO: 160322 - DNA, 892 bp, Homo sapiens
  Payload ID: 11352
  Gene Symbol: NCBP1
  Gene Name: nuclear cap binding protein subunit 1, 80kDa
  ENST ID: ENST00000478100
  CDS Start-End: 215-463
ttcgtagcccactgagcttcctcacgccggctgtcgcagcgcctagccccacccggcggcctctcctgcgcttccggggccgtggcgagctagtgcgcctgcgtgccggcccatccgcgcgccttgcagctgtccttgcgtcggccagcggccagacagttcctgcagcgcttaccgcctggcctctcggttccgcggcgcaccggagggcagcatgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagtgtccgttttttatctgatcttgtgaattgtcatgtgattgccgccccatcaatggttgctatgtttgaaaattttgtaagcgtaactcaggaagaagatgtacctcagaagacgccaaaagactcatgtacccatgttacaggtatggactgctgataaaccacatccacaagaagagtatttagattgcctgtgggcccagattcagaaattgaaaaaggatcgctggcaggaacggcacatcctaagaccttatcttgcctttgacagcatcctgtgtgaagcactgcagcacaatctgcctccttttacaccacctcctcacactgaagattcagtgtacccaatgccaagggtcatcttcagaatgtttgattacacagatgatcccgagggtcctgtcatgccagggagtcattcagtggaaagatttgtaatagaagagaatcttcac

SEQ ID NO: 160323 - DNA, 249 bp, Homo sapiens
  Payload ID: 11352
  Gene Symbol: NCBP1
  Gene Name: nuclear cap binding protein subunit 1, 80kDa
  ENST ID: ENST00000629069
  CDS Start-End: 1-249
atgtcgcggcggcggcacagcgacgagaacgacggtgggcagcctcacaaaaggagaaagacctctgatgcaaatgaaactgaagatcatttggaatctttaatatgtaaagtaggagaaaagagtgcctgctctttggagagcaacctagaaggcttggctggtgttttggaagctgatcttcctaactacaagagcaagatcttaaggcttctttgtacagtgtccgttttttatctgatcttgtga

SEQ ID NO: 160324 - DNA, 2169 bp, Homo sapiens
  Payload ID: 11353
  Gene Symbol: NCBP2
  Gene Name: nuclear cap binding protein subunit 2, 20kDa
  Uniprot ID: P52298
  ENST ID: ENST00000321256
  CDS Start-End: 95-565
aatgagatgctcgcctccgcgcgtttccgcttccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcacaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttattcggattgtcttctgtaataggtttcaataaagctggatgaactta

SEQ ID NO: 160325 - DNA, 564 bp, Homo sapiens
  Payload ID: 11353
  Gene Symbol: NCBP2
  Gene Name: nuclear cap binding protein subunit 2, 20kDa
  ENST ID: ENST00000411704
  CDS Start-End: 316-564
agcacttccgggtgagggaggccgggccgcgagacgggaaggccctgggcaagaacgctgagaaacgagggagagggaagacagtttctgcgctctgcgagctcataatcccctgtagtgaggattcagaaaagggaaaaatccccttgtgactgggaaaggaaggggcgcatatagcagaggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggca

SEQ ID NO: 160326 - DNA, 676 bp, Homo sapiens
  Payload ID: 11353
  Gene Symbol: NCBP2
  Gene Name: nuclear cap binding protein subunit 2, 20kDa
  ENST ID: ENST00000422610
  CDS Start-End: 331-591
actccgccctcggggaagcttcggagtggggaggtggacccgccaagctcggcactttgagggtgttcggatgtaaagatcggagaattgctggatttcagaagagggaaatttttagtccggactatatcacagtatattttgtggaaaaaggggaggcagcagatattcaaagtagacttttcagtatcagcggagggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagccc

SEQ ID NO: 160327 - DNA, 1946 bp, Homo sapiens
  Payload ID: 11353
  Gene Symbol: NCBP2
  Gene Name: nuclear cap binding protein subunit 2, 20kDa
  Uniprot ID: P52298
  ENST ID: ENST00000427641
  CDS Start-End: 58-369
atcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcacaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttattcggattgtcttctgtaat

SEQ ID NO: 160328 - DNA, 548 bp, Homo sapiens
  Payload ID: 11353
  Gene Symbol: NCBP2
  Gene Name: nuclear cap binding protein subunit 2, 20kDa
  ENST ID: ENST00000455953
  CDS Start-End: 503-548
ggcactttgagggtgttcggatgtaaagatcggagaattgctggatttcagaagagggaaatttttagtccggactatatcacagtatattttgtggaaaaaggggaggcagcagatattcaaagtagacttttcagtatcagcggaggtagggatggaatacggttgggggttggcggggcgggactcattaacccaattatttagtaaacgtttatcgagtgctgtcgccaaatccttgtgctaaaccctagagggagagggaagacagtttctgcgctctgcgagctcataatcccctgtagtgaggattcagaaaagggaaaaatccccttgtgactgggaaaggaaggggcgcatatagcagaggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttg

SEQ ID NO: 160329 - DNA, 1133 bp, Homo sapiens
  Payload ID: 11353
  Gene Symbol: NCBP2
  Gene Name: nuclear cap binding protein subunit 2, 20kDa
  Uniprot ID: P52298
  ENST ID: ENST00000452404
  CDS Start-End: 483-899
gaccagcacttccgggtgagggaggccgggccgcgagacgggaaggccctgggcaagaacgctgagaaacggtttgctcttgtctcattgtgtcgcctcccattcagctgaaatccgcaaacgccaagtggggccccggtgcctgctggcgaggcagggaatgggtgctggaagggcgcttggatatcactgaagccacttgctctggaagacggggaactggaggctcgcttatcccattcgctcgcagccgctccctgtaccccagccagtgccgagaggtttgagcggtggtggtggtggcggctcccgtttccacggttgtgcctccgcagacgactacgtagcaagggggaggggtgcccttctctctcccagagtaggcagaggcgccttcctgatgcagatgcggggctttttgctttgttttttaaatcggcgaagcagtgcccttcggcgattcgggccccttctctgggaggatggtgttacggaagctgtacgcgggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcaga

SEQ ID NO: 160330 - DNA, 2216 bp, Homo sapiens
  Payload ID: 11353
  Gene Symbol: NCBP2
  Gene Name: nuclear cap binding protein subunit 2, 20kDa
  ENST ID: ENST00000447325
  CDS Start-End: 351-611
gagaaacggtttgctcttgtctcattgtgtcgcctcccattcagctgaaatccgcaaacgccaagtggggccccggtgcctgctggcgaggcagggaatgggtgctggaagggcgcttggatatcactgaagccacttgctctggaagacggggaactggaggctcgcttatcccattcgctcgcagccgctccctgtaccccagccagtgccgagagggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcacaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttattcggattgtcttctgtaataggtttcaataaagctggatgaacttat

SEQ ID NO: 160331 - DNA, 2220 bp, Homo sapiens
  Payload ID: 11353
  Gene Symbol: NCBP2
  Gene Name: nuclear cap binding protein subunit 2, 20kDa
  ENST ID: ENST00000428425
  CDS Start-End: 92-256
gagatgctcgcctccgcgcgtttccgcttccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccgggtgagggaggccgggccgcgagacgggaaggccctgggcaagaacgctgagaaacgggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcacaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttattcggattgtcttctgtaataggtttcaataaagctggatgaact

SEQ ID NO: 160332 - DNA, 660 bp, Homo sapiens
  Payload ID: 11354
  Gene Symbol: NCBP2L
  Gene Name: nuclear cap binding protein subunit 2-like
  Uniprot ID: A6PVI3
  ENST ID: ENST00000509000
  CDS Start-End: 199-660
aggccctgtgggtcctatatgtgccctgcaacttggggaaaatggaggtggggttgtggtctctatgctgtagcagccggaaagccaaaaacaagccgtacttctcgctcttgacaggatcccaaggttttcagtggtggtgtcactgctgccaagctggaccgaaaacggccatcggcatgctgcccaaccagcaccatgtccaaagacctgaaaattctatgtaaagaccctgctttggagctgagctgctaccgggaccatcagttcagtggccgtaaatttcagcaggaaaaattactgaaggaaagctccacattgaatatggggaatctttccttttatacaaccgaagagaaaatacatgaactctttagtagatctgatatcaggaatatctttatgggcctggataaaataaagaaaacagcatgtggtttttgctttgtagaatgccataacagagctgatgctgaaaatgccatgcggtttctaactgggacctgcctagatgaatggattatctgcactgattgggatgtcggttttagagagggtcaacagtatggtcgcggtaaatctgggggtcaggtaagggatgagtttcgtgaagattttcattctggtagaggaggctttggaagacagactcagatctag

SEQ ID NO: 160333 - DNA, 12770 bp, Homo sapiens
  Payload ID: 11355
  Gene Symbol: NCBP3
  Gene Name: nuclear cap binding subunit 3
  Uniprot ID: Q53F19
  ENST ID: ENST00000389005
  CDS Start-End: 29-1891
ctctcagtggtgcggccggcaggcagcgatggcggccgtacggggcctgcgggtgtcggtgaaggcggaggccccggcggggccggccctggggctcccgtcccctgaggcggagtccggtgttgaccgtggcgagccggagcccatggaggtggaggagggcgagctggaaatcgtgcctgtgcggcgctcgctcaaggaactgatcccggacacgagcagaagatatgaaaacaaggctggcagcttcatcactggaattgatgtcacctccaaggaagcaattgaaaagaaagagcagcgagccaagcgcttccattttcgatcggaagtaaatcttgcccaaagaaatgtagccttggaccgagacatgatgaagaaagcaatccccaaggtgagactggagacaatctatatttgcggagtagatgagatgagcacccaagatgtcttttcctattttaaagaatatcctccagctcacatcgaatggttggatgatacctcctgtaatgtagtttggctggatgaaatgacagccacacgagcacttatcaatatgagctccctgcctgcacaggataagatcagaagcagggatgccagtgaggacaagtcagctgagaaaaggaaaaaagacaagcaggaagacagttcagatgatgatgaagctgaagaaggagaggttgaagatgagaactcaagtgatgtagagttggatacgttgtctcaggtagaagaggagtctttgttaagaaacgatcttcgtccagctaacaaacttgctaaaggaaataggttattcatgagatttgctacaaaagatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaactgtattgtcccatattttgttgattaaccttgctttttctccctccctttagagagattagaggatataaccatgatatatttcagcttcttattaggattctaggaaagagatggttctggtttctctgccagttgagacttaagacatctgagatttctcagcttttctttccctgtgaagcatacagctgagagccaggttcttaggaagggtcagggtttggggagttggtagagtgaggagtgcgggggcctgagaatcggacacctggatgccaacccctggctctgctccatggacctgggcctcagttttcccgtctagcagttgagtgggctgttaccagaattcctggctttgttggtgcatctcagtggcggtttactcttcccaagctgtgacggcagtgggctcgccagcatgaatttctactgcaggtggaggaggcgccagggagacaactgagggcgcgcatgaggtgtagacaggggcttattcccatcccagcacagtctctgcttctactgacggggcaaagatgtcttgtggtcagcgtcccagctggcatgcctctgcagggtttagaatatgctccttcacagactttccttttggttttacaccagcagctcaggtccatttgttccacggcctttcagcactcagcagtctcctgctacagatcagcgaagccattctggaaggaggtggtgtgcagtcaaaactgggtctttgatgtaaccaagagaaatacacactcgagtaaccttacagttttcacagacacacagagagaacccagaaaggcagctttaaagatttttacttctcggagttactggccttattagtttctctaaccctcctgcccactctcagtcactcagatcttgcaacatcttgagtgtgtcctgaatgatgaggccttttctttggagtttaagagtaagaatggatagtcaggacaggcccgtggcaggcagctgggcgtgattttaccctggacactccccacacatgtgggcacagggctgcacactttgtgtgttcctcttagtcttatgtgtaggagattttacatacatgtttgctgcttgatgataattgcagatacctcatttgtttcccactctcctctctggagagttaccaggtacccaggataatttgtggcgtcctcaggatgtagtctcctcctctggcccccttgtagtctgatcctgtgaacccctctccgttcttcagccactgccctttccagctgcatttgtacagcagcctcttcactggtctctgccctgtctccattctgcacactgcagcgggatgaacctttgttgttgttaccagcttaatttagatgtaatttgcatacagttcagccatttaaagtgtacacttgagtggcttttagtatatttacagttatgcaccagcaccgtaatcaattttaaaacactttgatcacccaaagaaaccctgagtccattagcaattctccctattccctcttccctcttagcctctggccaccactgatcttccttctctctctgtggatttgcctgttctggatagttcatataaatgggatcatatactatgtgtctatttgtgactggcttcttaacatatttctgaggttcatccatgtcatagcttctatcagtatttcattttttaaaattgccaaataatagtccattttatgggtatgccaccttttttttaatccacattggttaatgggcatttgagttgtttctactttagggctatatatatatatttctatttctattatttatttttgagacacagtttcgctcttgttgtgcaggctggagtgcaatggcacgatctcggcccactgcaacctccacctccggggttcaagcgattctcctgcctcagcctccagagtagctgggattacaggcatgtgccaccacgctggctaattttttgtatttttagtagagacagggtttcaccatgttggtcaggctggtctcgaactcctgacctcaggtgatctgcccacctcttcctcccaaagttctgggattacaggtgtgagccactgcacctggccctactttttggctattatgaatagtgttgctacgaacattcccgaacaagtttttgcagggacaggtattttcatgactcttgggtatatacctaggagtggaattgctgagtcataattatctttaaccttttcaggaaccaccaggtggtttttccaagcagctgtatcattttccattccaccagcagtgtgcgagggttccagtttctccacatctccaccaacactcattattttctggtgtgaagtggtatctcattgtagttttttgtttttattttttctttttaaaatacattttgtacagatggggtttcgttatgttgcccaggccgtctagcactcctggcctcaagtgatcctcctgccttgacctcccaaagtgccgagattacaggcatgagccaccacgcctggctctcattgtggttttgatttgtatttccctaatgactaatgatgtcgggcaccttttcacatgcttcaggatgaactttcttaaatatatatctgattctgttattcctctgcttgaacgttttccaaagcttcactattgccccgagaataaattccacactcctgatcgcatgagcccagtaattcaaggctgtggtgagctatgatcaagccactgcactccagcctgggcagcagagcaagacctgtctcaaaaaatacatacatacataaattccaccctttttgatagcatgttatgaggctcaccaaggtctatcctctggcagtatccctggcctgttctccccatctcccctgccctctgctcaccagttccctaaatgtatcttgatctcactagccctacagactgtgcacagagctgtttctacctccagtgacatgcttccgcccaggcttctccccctcccgcctcaatcttcccctcaccaacttaaggtcttaggggcccttctaggaggcagtccccaacttccagagccagggtataggctacttctatgtgtcccatggtactgccacagaagagtctcagctctctccaggattcagttctaaggtcagtgcctaagataaaaatggagtgtaattaaaattcctcttagaaatctaaggaaggtgccctattgaagaccaacatcttgaggtcccatgtagtcatttcttgcccatgtgggaacacattactgtttggttgagtaccaggtgaagtgattggcctgcagttagggctgtgttgtgcaaaaatcacttgttttggggtgttagaaccacatttaggcgagaagatcacttttggggagcttgggaactgaggcaggccgcaggtgcagcagaggcatgagcttgcccgggcccgccctcttgtctatgctcatggagtgaaggaggggccagcggaatggcccaaacaactgatttgtttttctttttttaaatctttttcagacaaataccattgtgtttaagcgaaatgtgtgtataatgccaaatcactgtaccccacaaccctgcacacctctacactggactgtaatttcttgttcctagtttgtcttgctagactgtaagctccgtgagagcagggaccgtgtctgcttgttgagtgggctttcccctgtgcctgccagcatgcctggcatctagcaggtcttctgtaaagatgggatgagtttgtaaaccctccagcctcaggagtggctccatcctctgaggctctggggccctctggcaggctagtcatttttctgccatgtacgtacaatgctttattttcatgttgtattttcctttctagccagtaagcaagctcctaatgagcaagtttctttgtggtgttatctctgtatcctttcatcaggccagcccagagtaagtagtgcttcgaaagtgtttggtaaatgaatgaattatggtaacccagcccagttctggcatcactgtctgcaggttagtctaattccagatgaaagccccagattcgaaaaagggaagattattcagaagtgcatatggttgtataagaaaaaaaaatctcattaaatagacctgagtaaacttcaaattttgatgatctggccatgtcggagctgaagcttaccagctctctaaagcatttgctagggaatcatgcagatggtccaaaatattttttagaaaagcattcatctgtcccgggatagaagtagaggaagctggtaggcaggcgctagaccctaaagaaggactgctgagccagttcttaagcctgtggtcctgtcggtgaggaaagtgagagcagtccagagcaggtgaaaagagcagagctcattcctccagtggctcttttgcctaaagcagcattcctcaaacttctcactcgaagcattaagttacggtgagatgctaacacacgctttagacttaagtcaaaatttactgtgaagccacagcaaaccatggcttcacagatgaattagttgctacacaaataagttcgatacataagtacagtaattgcttttaaaccttataataagcagtaaattagaagttaaaccatgtttttcttttacgaactgaaagaagagaatgcttttgatactgagaatcgcacactgtgtccaggaagattgttcttgcataaccagacccacaataaatatctacaacttttcttacatgtttataaaataaatcttagaagaaaaatattgtagcttttttttttttttttttttcaatgaagctctatgaacatttcacagaactttgttcctgggagtagttagggaaatgctgcttcaaaaagccaattttaagtagttgtgaggcatccgagtggaatttggctgcactatccataaaacttgagagtataggcggtatttcacctaccaaggtcagtaccctgcctcaggattcttactgttcatttgagcaattccggggccctctctggatgaccaggttcgtaaatagttgagactttgtgttatctcaaattgtcaccatcacctctgggccaatataggttagtgaggtcgagaggcccacaccattgacagaagagaattctcaggccgggcttggtggctcacgcctgtaatcccagcactttgggaggccgaggcgggtggatcacctgaggtcaggagttcaagagcagcctggccaacatgttggaaccccgtctctactagaaatacaaaaattagctgggcgtggtggtgggtacctgtagtcccagctacttgggaggctgagacaggagaattacttgaacccgggaggcagaggttgcagtgaggtgagatcgcgccactgcgctccagcctgggcgacagagcgagactccgtctcaaaaaaaaaagaaaggattctcaccttcctgtcccttcctaggagttttgtggtagtgttcgatcctgtgatgtggccatcttctcctcagggcctgtgagaggcaggcagcatctttagctgaggtagaatgcctgttggggaaagtcaaataggatggtggctggggccggggctctggggactccttctgccccacatactcaattggaaagactgagcaagtcccctcacctccctgggcctcagcttccctgtctgtcaaatggagggctcaactggggtgagctccagtttccttctagtgctaacgcgtgttcaaggatccttgctctcctttccggggagcatcaggggtgtgggctagatagcaggaaagaagtaggggtttgtaaacaagagatccaagcccctggacccttggtcccagcacccagtgcagccctcgccctcccagccccttccttagaaaggacaagaaaatccactccttgttctctccctgtcccatcacccccgcagtcccccacagatctgaggccggaggatgccaacatggtgagcaccctcttgctgtcttattcacgtaggcttttcttggtgcctgcacatggctcttgtaaggccaccaatcttgctggattatgacctcatctaaccttaattacttcctaaaagccatatgtccaagaagagccacattgggggttagggcttcaacatatgaatttggaggacatttacagttcagtccacagcacctggtcatgtggagatcccagtctgcatttgtgggatgaaatctctgcttttttaaagtttacacaccacctagctgggcacgtggctcacacctgtagtctcagcactttgggaggccgaggcggggatcacctgatgtcaggagttcgagaccagcctggccaacatggtgaaaccccgtctctactaaaaatacaaaaattagccgggtgtggtggcgggcacctgtagtcccagctactcgggaggctgaggcaggagaatcgcttgaacccaggaggcagaggttgcagtaagctgagattgtgccactgcactccagtctggatgaaagagcaagactccatctcaaaaacaaaaataaaaaaagtctacacaccaaaagagctgaaggcaggagagtttgtggtggttcagagtcctgattctggaggaaacaggcctgtttggagtcccagctctgctccttactagctatgtggcctctcagaggcagcatccttatctgagaaatcgggttgaccttgtaggtggctgagaggctcagatgagggctcgcatgtgaggccttggcactgagcagggcactcctaccgagtgttcaaaggtcgtgagtaccactgctctgcagccctgggctctggtctcagcaatgccgtcactctttctggcttcctaagagtcagaaggcaagtgggagaatagaaccatttcctgtgtctgaaggctgtgcctcagtgcttttgactcactctgaagacagcaggcagccctttctgttttttttggagatgaagtcttgctcttgtcgcccaggctggagtgcaatggcgcagtctcggctcactgcaccctccgcctcccaggttcaagcaattctcccaccatagcctcccgaagctggggctacaggcacacgctgccacgcctggctaattttttgtgtttttagtaaagacagggtttcaccatgttgcccaggctggtctcaaactcctgaactcaggcgatccgcctacctcggcttcccaaagtgctgggattacaggtgtcagctaccacgcccgacccacaggcagccctttcacctcacgccgagcacgtctcctccatccatgaacattttgcaacttttttttaaagagacaggttcatactatgttgtctagattggactcaaactcctgggctcaagctttcccaagtagcttgaacctcttaagtaactgtgactacaagtgcacctggccactttttctgagacggagtctcgctctgtcacccaagtggagtgcagtggcatgatctccgcccactgcgagctccgcctcctgggttcacgccattctcctgcctcaccctcctgagtagctgggactacaggcacccgccaccacgcctggctaattttttttgtatttttagtagagaccgggtttcaccgtgttagccaggatggtctcgatctcctgactttgtgatccgcccgcctcggcctcccaaagtgctgggattacaggcgtgagccaccgcgcctggcccacctgcccattttttaaaaactttattcttcctggtatcaaggggagaaagaaaaaaattttttaaaatatttaaaactttattttgaaataatttcaaaatcacagcagtttgaagggtacaacaaagaacattttgccacattttctctttcattcgttccctcctcttctccctcacccctgtttcttcctatcctctctgaaccatgaaccatttgaggattatttgtatacatcatgctcgtttatccgtaagatgttttagtgaacatttcccaagaacagggacagcctctcacatgcccatggtacagttctcaaattcaggaaatgtgtaatattctctgatcagcccaggagttgctaatttgtagttcctgtttcaaatttgccaactgtcccaataatgattttgaaagccgttgtttttctggtccaggatccaatccaggatcaagcgctgcctttagttgtcctctctgcagcctcctttcgtttggagcaggtcctcagcctttctgtctttcatgacattgatgtttgtgaagagtacagtccagtttctgttgtagaacgtccttgaagttggtcccggaatatttgtttaaagtgagttgggaaaccacattcacatgtcttttggttatgtgtgtatttgtcaaacagccagccttgtgctgcgtgctgtgatggggagcattactcaacagagcctggccctgaccttggggatgtagtttgggtttgtggggaaagcagctaccgccaggtgggctttacggacccctgtgtgtctcatgactagaggcactgacgcttggataaatacatactggatggatgcaggatgagtccgcattctagaagtgtgcagaggtacagaagtggccctgctccctgtccagcacccagtcatcagctttccctggcttcccgaggcaccctgacgttcacactccaaacacaaagtcttctctcaggaatctcgagtgagctgcagtctgggttctagccctgccctagcagggatctgctcagtgactgggctgctctcttcctgctttaggccaatgcgggggagaggagaccactgtgactctccccagtgcccttggagcgcagaatgaagtgaggggaggaggagggtcacgagccctggagcgctgggaagacaggctgtaggccgcaggccccgatcctgcctgggacgaggttcaacagaagtaggatggtttcatcatgacctggcaggaaaaccaccagacctggaattttgcttttacaactgtttaacttctgtttcatacaggatggaaaccggtgaattgtaatctcacataaccgagcaagatctagtagtcataagcactttgtcagagcaaagcagacaaggcaaagtgttggaaatgtcatcggatcttcacagaaccttagccaagcagcctttcaatgcgagaaacaaaataacatggatttttatctagtaatgaagtcaacaccattgtccaccctgggttaacacattcacatctcaaagcgaatggggctgcagacactcgtgttagagagccttggaatgtcctgcctttttacgtttaattaaaattaaataaaatatacaaaatt

SEQ ID NO: 160334 - DNA, 249 bp, Homo sapiens
  Payload ID: 11355
  Gene Symbol: NCBP3
  Gene Name: nuclear cap binding subunit 3
  ENST ID: ENST00000576523
  CDS Start-End: 1-243
cccaagaccaaagaaaagaatacgaagaaagtggatcacagggcgcctggcgctgaggaagacgactctgagctgcaaagggcatggggggctctgattaaggagaaagagcagtctcgccaaaagaagagccgctgttaccagcacccttttcccaagaaaagtcaattcccaggtgcttattggacatccttcgagggggaagaggagggaagcggccagctcacccttccgggaccctagtgtggg

SEQ ID NO: 160335 - DNA, 2701 bp, Homo sapiens
  Payload ID: 11355
  Gene Symbol: NCBP3
  Gene Name: nuclear cap binding subunit 3
  ENST ID: ENST00000574911
  CDS Start-End: 1-109
gtctttgttaagaaacgatcttcgtccagctaacaaacttgctaaaggaaataggttattcatgagatttgctacaaaagccccaggtctaggatccatccaggactgagtgtatgacaaaaaggaacttggagcagccagaagaagtcagtattacatgaaatatgggaatccaaattatggaggcatgaaaggaattcttagcaattcatggaagcgaagatatcattcccgtcgtattcagcgggacgtgatcaagaagagagccctgattggggatgacgttggcttgacgtcgtataaacatcgacattctgggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcagatatacgccagcggttaggaaaaagaccacattctccggaaaaggcttttagtagtaaccccgtcgttcggagagagccctcttctgatgtgcatagtaggctaggtgttcccaggcaggatagtaaaggcctctacgccgatactcgggagaagaaatcaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccattaggaggaggtagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgttgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaa

SEQ ID NO: 160336 - DNA, 6496 bp, Homo sapiens
  Payload ID: 11356
  Gene Symbol: NUCKS1
  Gene Name: nuclear casein kinase and cyclin-dependent kinase substrate 1
  Uniprot ID: Q9H1E3
  ENST ID: ENST00000367142
  CDS Start-End: 304-1035
gtctccaatgagcaggcgtgttggggaggagcgcacaaaccctagtgggtttggttgcacggcggctttggcgcattttcggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacatctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaa

SEQ ID NO: 160337 - DNA, 5590 bp, Homo sapiens
  Payload ID: 11357
  Gene Symbol: NEMP1
  Gene Name: nuclear envelope integral membrane protein 1
  Uniprot ID: O14524
  ENST ID: ENST00000300128
  CDS Start-End: 25-1359
aggaggaggtggcttgaggcaaccatggcgggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcagtttagtatctggaactttttttcctcctttttaaaagagaaattgaatgacacctatgttaacgtgggtctatacagcacaaaaacctgcctcaaagttgagattatagagaaggacaccaagtacagtgtcattgtgatccggagatttgatcccaaactctttcttgttttccttcttggacttatgctatttttttgtggagacttgctgagcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttat

SEQ ID NO: 160338 - DNA, 5370 bp, Homo sapiens
  Payload ID: 11357
  Gene Symbol: NEMP1
  Gene Name: nuclear envelope integral membrane protein 1
  Uniprot ID: O14524
  ENST ID: ENST00000379391
  CDS Start-End: 19-1134
aggtggcttgaggcaaccatggcgggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcaaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 160339 - DNA, 1381 bp, Homo sapiens
  Payload ID: 11357
  Gene Symbol: NEMP1
  Gene Name: nuclear envelope integral membrane protein 1
  ENST ID: ENST00000554340
  CDS Start-End: 19-351
aggtggcttgaggcaaccatggcgggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcagatttgatcccaaactctttcttgttttccttcttggacttatgctatttttttgtggagacttgctgagcagaagtcaaattttctactactctactgggatgactgtgggaattgtggcctctctgctaatcatcatttttatactatctaagtttatgcctaaggttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcat

SEQ ID NO: 160340 - DNA, 549 bp, Homo sapiens
  Payload ID: 11358
  Gene Symbol: NEMP2
  Gene Name: nuclear envelope integral membrane protein 2
  ENST ID: ENST00000343105
  CDS Start-End: 24-281
gcacggagctgacccctaacgaaatggggccgcgccaagggcggtggtggctgctgctctggctgccgcccctggccacactgcccgtgcgcggggaggcggcggcggcagcgttatcagttcgtaggtgtaaagctttgaaggaaaaagatttaattagaacgtctgagtcagactgttactgctacaatcaaaattcccaagtggagtggaaatacatatggtcaactatgcagggagactgtgtgcttctctgtggagcctgtcaagaagatatttaactatatgatacatgtgaatcgaaacatcatggatttcaaactcttccttgtgtttgtggcaggagtttttcttttcttttatgcaaggaccctgagtcaaagccctactttctattactcctcgggaactgtgctaggtgttctaatgacattagtctttgtcttgctgttggtgaaaagattcattccgaagtttatattgtatgccagttgatggaagatctgaagtggctgtggtatgaaaacaggatatatgtattaggtaggt

SEQ ID NO: 160341 - DNA, 6168 bp, Homo sapiens
  Payload ID: 11358
  Gene Symbol: NEMP2
  Gene Name: nuclear envelope integral membrane protein 2
  Uniprot ID: A6NFY4
  ENST ID: ENST00000409150
  CDS Start-End: 68-1321
acttccgctcctcgcagcggagccggtcccctagggctcgggtcgcacggagctgacccctaacgaaatggggccgcgccaagggcggtggtggctgctgctctggctgccgcccctggccacactgcccgtgcgcggggaggcggcggcggcagcgttatcagttcgtaggtgtaaagctttgaaggaaaaagatttaattagaacgtctgagtcagactgttactgctacaatcaaaattcccaagtggagtggaaatacatatggtcaactatgcaggtgaaaattaccagtccaggcctgttcagaattgtatatatcgcagaaagacataattgccaatatccagaaaacattctatcttttatcaaatgtgtgattcataacttttggataccaaaggaatctaacgaaataaccataatcatcaatccatacagggagactgtgtgcttctctgtggagcctgtcaagaagatatttaactatatgatacatgtgaatcgaaacatcatggatttcaaactcttccttgtgtttgtggcaggagtttttcttttcttttatgcaaggaccctgagtcaaagccctactttctattactcctcgggaactgtgctaggtgttctaatgacattagtctttgtcttgctgttggtgaaaagattcattccgaagtatagcaccttttgggctctaatggttggttgttggtttgcctcagtttatattgtatgccagttgatggaagatctgaagtggctgtggtatgaaaacaggatatatgtattaggctatgtcttgatagttggatttttcagctttgttgtttgttacaagcatgggccccttgcagacgacaggagcagaagtcttctgatgtggatgctgcgactcctctccctggttctggtctatgctggtgtggccgtgcctcagtttgcctatgcagccataatcctcctcatgtcctcctggagtctgcactacccactgagagcatgcagttatatgaggtggaaaatggagcagtggtttacatcaaaagagctggtggtgaaatatcttacggaagacgagtacagggagcaagctgatgctgaaacgaacagtgctctggaggagctacgccgggcctgccgaaaacccgactttccctcatggctggtcgtctccagactccacactcctagcaaatttgcagactttgttcttggaggaagccacttgtcacctgaagaaatcagtctgcatgaagagcagtatggccttgggggtgccttcttggaagagcagctctttaacccgagtactgcctgacatgcgaccttcaagttgacttcattctggacaaggaagtgggcaaagggcagggattctattaaagttaggcagaactgttctagtgaacggtggcaaaaacatttgctgtggagaaaaacaagtcagtctggaaagggaaaccaacccattttgaagataacttagcattcttggtgacttctgctacttattgtactgtaggtggataccaaaattctgtgacagccactaccacttaccttgaatgaaggctttcattaggaacaggggaatggcgttgttcttaaggggctagtaagcatgaacaggtgctttgtcgacaccagggcactaaatctggtcttaatcccctgaacctgtgtcagaagactctgcaatactcttcctatagttcgtcagtataagtccttaaagagacctgagacatgctggaccagtgttttccaaagtacagctcacaggctactaccaagtgttggtcaataaaggtattctgaggtcaactaagattgatataaagttaaactaatgtatttcagtatctctcagaggcattcataatgctcgtgtgcactgtgaatctcccaaaggggagaaattgtgtgctgcagtttcttgcttaatttgaccacagaactctttttcatgagattaatattccttggaacacgtttggaaaatgctaatggtggtggaactgagctcatgagaggttaaataacttgtgcaagaccacactgagatgcagcactggtagaaatccagccctgatgtatcctttgactcaggtagacaagatcttcaggtgcaagcttaggagccatctccctacagccatgggcctcacaatgttggtggctttactttttatttttcaataatggccaacttgctatttaactgtgataaagggaaatgtttctgaagacattttaaagttttttatacatacgtaagatttttatatacatacgtaaggattagatactatgattactttttttgtattttgaaattgaaggcacttaagctcttgtgatattttgaattgactgatccatttaaaaaattgtttagctataggtgtttgtaacaatttcttataaaatgattttttttcttgattcatgatattaaactccagattgaaatgaggggctatgagctttgaccctgaggaaagaaggccaaaacatagatctgaggaaagatttgaacatggcaagacaatctcagggttaagatgttgctaagttgattctgagaatcaaaatcaggctttttttcctgtgatgggatcataaaaataatctttttatcaggacaaaggttatgggcgaaggatagacagaattttggcactgctgctttcctgagccaaattaagtagtttttctaaatcatgaaaaaagagcatgactatccatctggaacttcctagattgattttcaaatgatagttcctctttgaagtatttacaggtctgtttttgccagacatcttttcatactgggaacttttttttttgtaatatccactaaagttaatctgcctttatatagacttggatttttaaaaaaccaaaggatatattttccattcagatttatggtaactattttatgagtaaatagaagtttgaatatttttcttatggtttaatctgtttttttaaattatatttattggtgatataaatgtatcagatgtatcagtgcctgtgctcaccaagttcgtctcctaagaagcagtttgtgtgctacaacgtatgcgtatgagtaaataacacatgaacaatctgctggggctgccaggtacatcccagccaggacagccgctgggccagggggaagaggtactgctgagggaaggaagcagctcttcatgggcagctagccaggtgtaaccatcacagtaaaaacagccaaagagagaagaacaacagcagtccttgaggatattgttttccatgtttatttttagaggaaatcataggtttgtcagtttctgctttgtgactactgtgagaagctaaacaattagaagcattacttgtgatatttttagtgtatttatgttgttttcatttgatttgggggtgtattatagtactgatcacaattctaatccccatcaagcaatgtacagataactcttccaagaaatgtttccctcctttctttcctcccttcccttctctttctccctcacctcctgtctcctctcctcctccctttttaaaggcctttgaacagtttaaacgaccactcaataaaatggctctgcccttcacaggtggttggaagttggctttgtgcctcacacaccataggtgtataattatggagcctaacagatccctttgttattttactgcttatgcttggtgcctacaaaagcttactgttgttagcaagttgaactctttgacaccagatgtgtgggtgagatatagtgtaggtggctatgcttaaacaatcgtatcattcaagtgttatttttaaaaggttttaaaacacattttacatatcacaaaaaatgctttgtgaattagttgtatggtttgccagtaatacctagggctgaattacaggggaatgtccatctgacatgaaggacaatatttcaatttatgactttttaaaaaaatctggaaatttcatatatttagattttaagagggtttggaatagatgatggattacataaaaatatctaaatatgtggaggaattaagatcctgaaatgatgtcaactaaagaaatgctctcttacattatgctatgtgtgattgtttcccagagtgagagatgtacaattttataaattagcttttcttgtccaactgaaagcaagatagacaacataatggatgtggaagtttgaagacacctgcaggaagacagagaggtacttttaggtgacaacaggagcaagctgccttctgagagagcctgctgggtggcatgacattgaagagtgaactatttgggtgtgactgttagccttattgacttagaaccctgctttttgttattgcaccataagacctgtctcttgttagtcaattcatatagttggtacaggtagtgattcacaaccaaaaatataactagcataaggataaaaacacttgacttgatatgaccagcagattctctctcagaagacagatttacaaggggtcaaattataataaggtggctacttggtgaactgaaacaaaacaaagggagcttgttatataattcacatggttaatgtcatgaggccaaagagtttgatgcagatgccaccccccaccccagtggggctagccttgttaatgggatgagataccaggtctgttgacaaagaccacgccttcctttatgcaggtcctgccaactttttcctctctgtgactgctgtttttctaatcttcattattgacaaacatcccaccccctctgatgggcatatttttactcagatgtgttaaaatctttagtctttctctggcctaggagttggattatcttttaaaggtaactgtattttttttgttatgatccctgaatgtgaaaccttaataggtcaccagagatttgaaatgaatactatacttatctaatataaatcttggaagatacagttagtgggtagcttctctattatttaaataatttgaggcatctgtttttttagatttggtcgtttttccaaaaaagaaagactgattgaaaagagaaagggaaagaataccaacattgactagagatccatcaggcactatatgaggcaccttcgatacctcttaatttgcacctcatgaccactctgtgatatgttttggtattttcattttacagatgaggaaagacccagagaaggtaggagaaagttgctgaaggacacatatagctaaagtggtagaatcagaattcaagcccccatatgtctgcttccagggctcatattctacttcctttatttattaccatctttttaagaaagtgaaggaaatgaccccatggataaggcattcaagaggtgactacatctgctgatgttatacacataccagtcatttgtgccccgcagcaatggacactgtagtctgcggctcttgtcagtgcttctcagactgtctggggtgatggaccagtttccctctagttcatcactagtaatacttttgtaagatacactaaattattagaaaaatgaaataatctttgaaagaaaagacatacagaatataagcacgatgatcatgtcatgacaatgtcaacttgccatacatattttgaaatgtctaatttctatgttgtcacataccagcagtagtttgacagcaccagtcattgagcacactttgagtagcactggtctacatgttatttttctaagatgccagtgatcttttcaggaaacaaaaaaaatccgaccttttttcaaatgtaagtttacaatttaaaagaatagcatcctacactgactattggagagagtatggtatataatttgttaaatgattataaaattgtttacttttgttgacacctttaagaagaaaaagaaaaatgaaaattatgaaacttataacctctctcagcagacttttgcactttatggaattgtcaccatcatcacttttttccatcctcttcaacttaagttttgcttaattttgtctcttaactaactcatatccccaaccacttaatgtttacaatgcatgttggaattgaatgccttactgtacagcttactagatataggtaaatatgtatagtatggcactgtagattgggagaatggaatatgattatagatttaaatggcaataaaataatagaac

SEQ ID NO: 160342 - DNA, 643 bp, Homo sapiens
  Payload ID: 11358
  Gene Symbol: NEMP2
  Gene Name: nuclear envelope integral membrane protein 2
  ENST ID: ENST00000444545
  CDS Start-End: 1-108
gactgttactgctacaatcaaaattcccaagtggagtggaaatacatatggtcaactatgcagggagactgtgtgcttctctgtggagcctgtcaagaagatatttaactatatgatacatgtgaatcgaaacatcatggatttcaaactcttccttgtgtttgtggcaggagtttttcttttcttttatgcaaggaccctgagtcaaagccctactttctattactcctcgggaactgtgctaggtgttctaatgacattagtctttgtcttgctgttggtgaaaagattcattccgaagtatagcaccttttgggctctaatggttggttgttggtttgcctcagtttatattgtatgccagttgatggaagatctgaagtggctgtggtatgaaaacaggatatatgtattaggctatgtcttgatagttggatttttcagctttgttgtttgttacaagcatgggccccttgcagacgacaggagcagaagtcttctgatgtggatgctgcgactcctctccctggttctggtctatgctggtgtggccgtgcctcagtttgcctatgcagccataatcctcctcatgtcctcctggagtctgcactacccactgagagcatgcagttatatgaggtgg

SEQ ID NO: 160343 - DNA, 1119 bp, Homo sapiens
  Payload ID: 11358
  Gene Symbol: NEMP2
  Gene Name: nuclear envelope integral membrane protein 2
  Uniprot ID: A6NFY4
  ENST ID: ENST00000414176
  CDS Start-End: 449-865
attttgtaattttagaattagaagcaaccgcgcgatccagtcgcccaattccctcgttttacagaagcaaccgaaactcagagaggttttgatttgcccagggtcacacagcttgtcactggcacagctgaccctagtctccagactttcagcacacggccttttgtacagtacatcaatgcgtgttgaaatccttgttatttcactatctcgcattcctttggtctcaagactagagaaggtaacagcttcagcttcagaatcggagcgaaaattcttctgcccctgactgttgtgaccttgagcgagtaaacataacggtcccacgtgagcggcagttcgtaggtgtaaagctttgaaggaaaaagatttaattagaacgtctgagtcagactgttactgctacaatcaaaattcccaagtggagtggaaatacatatggtcaactatgcaggtgaaaattaccagtccaggcctgttcagaattgtatatatcgcagaaagacataattgccaatatccagaaaacattctatcttttatcaaatgtgtgattcataacttttggataccaaaggaatctaacgaaataaccataatcatcaatccatacagggagactgtgtgcttctctgtggagcctgtcaagaagatatttaactatatgatacatgtgaatcgaaacatcatggatttcaaactcttccttgtgtttgtggcaggagtttttcttttcttttatgcaaggaccctgagtcaaagccctactttctattactcctcgggaactgtgctaggtgttctaatgacattagtctttgtcttgctgttggtgaaaagattcattccgaaggctatgtcttgatagttggatttttcagctttgttgtttgttacaagcatgggccccttgcagacgacaggagcagaagtcttctgatgtggatgctgcgactcctctccctggttctggtctatgctggtgtggccgtgcctcagtttgcctatgcagccataatcctcctcatgtcctcctggagtctgcactacccactgagagcatgcagttatatgaggtggaaaatggagcagtggtttacatcaaaagagctggtggtg

SEQ ID NO: 160344 - DNA, 432 bp, Homo sapiens
  Payload ID: 11358
  Gene Symbol: NEMP2
  Gene Name: nuclear envelope integral membrane protein 2
  ENST ID: ENST00000421038
  CDS Start-End: 360-432
agttggacattttgtaattttagaattagaagcaaccgcgcgatccagtcgcccaattccctcgttttacagaagcaaccgaaactcagagaggttttgatttgcccagggtcacacagcttgtcactggcacagctgaccctagtctccagactttcagcacacggccttttgtacagtacatcaatgcgtgttgaaatccttgttatttcactatctcgcattcctttggtctcaagactagagaagttcgtaggtgtaaagctttgaaggaaaaagatttaattagaacgtctgagtcagactgttactgctacaatcaaaattcccaagtggagtggaaatacatatggtcaactatgcaggtgaaaattaccagtccaggcctgttcagaattgtatatatcgcagaaagacataattgccaatatc

SEQ ID NO: 160345 - DNA, 6234 bp, Homo sapiens
  Payload ID: 11359
  Gene Symbol: NEMF
  Gene Name: nuclear export mediator factor
  Uniprot ID: O60524
  ENST ID: ENST00000298310
  CDS Start-End: 451-3681
atttcaaaatcttatgtcaaagtaagcgcgcagaaaggggtccttgctcttctacactgagccctacggcccccctgtggggaaatactcctgataatcatctcgaaaattgtttcgaccagcaggggtcactatgaaggctgacttgagcccaagacacaatggggcacggtaaccagactggtccgtaagggttccaggaaggaatgcagtttcaagagaacagtttgaatctttattcgaatttgaattttggtacaatgaagagagtcagctgcaacttgacaatcgaaatcttcagaaaagcgacacaaatacgttcgcctcgaggaatattgggtcttctgcgcggccgtagagctccgccaagtgcgcctgcgcggaggagaagtggcgtcgagtccggccgggcagtagaggaacttgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccaagcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaacgtaaaaaggaaatagctgaaatgaaattctaaaatatttgagaagagccaattttatagccttttggaagttcaaagatgaaagcaccatgtatcaggatttccgcattataaaaatgaactaaacattgccttgctatattcaccaaaaggacttacttcttgttttttcccagttttatatagaggaaacactgtctatgataggatttccaaaagtatttgtggacagttaaatgctaattaatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatattacaggccaaatgaactaaacattgccttgctatattcaccaaaaggacttaattcttgtttttttcccagttttatatagaggaaacactatgataggatttcctaaagtatttgtggacagttaaatgctaattatatacatctgtagttattctacattttcttgaaatttgggaggttaataccaagtattcatttcatgatgtaaagaaactgaacagtgaagtggcttgattgcttaaactattgacttggtaagtctactgtatataacatctaatatatatatattataggccagctacaaggggtttaaatatttaggattgtgtcttgaaaactaagtattggagtggattttcttctgctttcattgatacttgtcagaaaaaaatattagaccaaaatgtaaaatataagtaataattctcatgactcagcttaatcatttctattcatttgtagaccttcaggtttgatcttaattttttccttgtaatctgattcagttctgtaccattttaatttccacctttagtaattaattaccaatatagcacgttagagtatcttaacctataataccagaagcgcattttaggcttaccactaaagactctaacccacttttcctctgtctcttaacagaatggaaaatgatgtcatcattatttccattccttcatgagctataaaacctattaattaaaaaaaaactttttaattgactggacagcacctgcctgtattcagcatgaccacttgctccagcccctacactgaagcattaaggtcaaagtactgaacagttgttggtccctccacactttgtttttccagcttcgtcataatgtgaatattaatgtttaaaaaaaaaaacctttattatattgtatttacaacactaggttacataactatagactactcttgccattaaaaaaaaaaaaatctataatgttttcaaaaaatgacttcagcattttgatgatggtaagactataatgtttctacagatacatatcctgaagttactgaaaagaaaatgtagcaaccattcttcagggtaaaaagcccaaccattactttactttaatagaggacagctactggtgttaaatacatttattgtaaactttagacacaaaaataggttctctaggccattcacatgcacattaaaaccaacaggtgcaaactacaacaatgcatataattatacaaatgatgccactctgtgatgtttacaggattgctgtccatgcaaggtgatcataggcattatttatgaagccttaagatccagaagtgttgttactaccaaacctctgattaacactgtgaagtaagtgttttggaaggcagttccatgagttggctaacatttctttaaagcaaatgactgcttctaagcttagcctgaaagtggacaaggaaagagaaaagtaatttcactttactgtttggaagtacattcacttgaaaaactacataaaacatccctctttctttcttcaaagattttcataggaactggttatagcaatgaagttttattgcccttaaataatccataaacctagtttttcgagagtgctaagtcttaggaaacacaattttaaataatctaagtgccaagtacaaagttacttaccgtacaagagattttggttgaactgaaaatattagtatttcattactgtgtgcctgaaaaataaataggaagaacacatttaaaagcaaatgctttgcaagtaagtttcagtaataatgtgaaggtagtatacttacagctctgtgatggacaagcaagttgttggcacatccaccaaaaacaattacttctccttcatcgctggcacaagctgtgtgccataacctgcatttaaaacaaaaacgagtttgaagccacccagaacaccagttggccattttatactacagaatagagctatgaaataaagactagcgatcttaaggtagttcagaccaaaacatcatggcgagaagtaaaatcttaagggaaagtagcaaaagcagatcaatcaatatctattttatctggatattattttctctctctggtcgttctcatttatgcaatgaggagtttgaactgaacgatctgttctctaggtctttgttagcaataaaaatcgtatggga

SEQ ID NO: 160346 - DNA, 570 bp, Homo sapiens
  Payload ID: 11359
  Gene Symbol: NEMF
  Gene Name: nuclear export mediator factor
  ENST ID: ENST00000554626
  CDS Start-End: 36-570
agaggaacttgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaaggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaag

SEQ ID NO: 160347 - DNA, 590 bp, Homo sapiens
  Payload ID: 11359
  Gene Symbol: NEMF
  Gene Name: nuclear export mediator factor
  ENST ID: ENST00000556672
  CDS Start-End: 69-434
gaggagaagtggcgtcgagtccggccgggcagtagaggaacttgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggtaagttaaatttgtgggatatggtgaaggaaaatttcttattaatcattttgtaatagtgctatataacatgagtgggggaacattttttttctgtgtcaaaggttgttactaccctaggaaatgggtgccacacaaataaaataaaattttccagtaataacc

SEQ ID NO: 160348 - DNA, 3029 bp, Homo sapiens
  Payload ID: 11359
  Gene Symbol: NEMF
  Gene Name: nuclear export mediator factor
  ENST ID: ENST00000555970
  CDS Start-End: 34-3029
aggaacttgcggtagtgaccctcgggcctcgccatgaagagccgctttagcaccattgacctccgcgccgtactcgcggagctgaatgctagcttgctaggaatgagagtaaacaatgtttatgatgtggataataagacataccttattcgtcttcaaaaaccggactttaaagctacacttttacttgaatctggcatacgaattcatacaacagaatttgagtggcctaagaatatgatgccgtctagttttgccatgaaggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccaagcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagc

SEQ ID NO: 160349 - DNA, 1348 bp, Homo sapiens
  Payload ID: 11360
  Gene Symbol: NFIA
  Gene Name: nuclear factor I/A
  ENST ID: ENST00000371184
  CDS Start-End: 39-1181
cacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaa

SEQ ID NO: 160350 - DNA, 1714 bp, Homo sapiens
  Payload ID: 11360
  Gene Symbol: NFIA
  Gene Name: nuclear factor I/A
  ENST ID: ENST00000371185
  CDS Start-End: 45-1508
accgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggattttttttttttt

SEQ ID NO: 160351 - DNA, 2683 bp, Homo sapiens
  Payload ID: 11360
  Gene Symbol: NFIA
  Gene Name: nuclear factor I/A
  Uniprot ID: Q12857
  ENST ID: ENST00000371187
  CDS Start-End: 172-1668
gacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaatcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaa

SEQ ID NO: 160352 - DNA, 1989 bp, Homo sapiens
  Payload ID: 11360
  Gene Symbol: NFIA
  Gene Name: nuclear factor I/A
  Uniprot ID: Q12857
  ENST ID: ENST00000371189
  CDS Start-End: 83-1747
acaatgctttgagccttaccgcatttcagtgggggaaaaaaagttacctaggaggtctgatttttcaaagaaatttgcatacatgcaaatgtgccgcccggcctcctcctcggttctctacgtgcccacgcggtggcccggggggtgcggggcaacctggcaaagttgcccaagtcctccaccgagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatgg

SEQ ID NO: 160353 - DNA, 1916 bp, Homo sapiens
  Payload ID: 11360
  Gene Symbol: NFIA
  Gene Name: nuclear factor I/A
  ENST ID: ENST00000371191
  CDS Start-End: 113-1711
ttttttttttacccatgattccatatggtatggaccggactacatgttgccccacatgccactgcaaatgttttctcaattaggtgtcttatctcccgtgagttagcatcagatgaagcttgctgacagcgtaatggcagggaaagcttccgacggctccatcaaatggcagctctgctacgacatctcggccagaacttggtggatggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttt

SEQ ID NO: 160354 - DNA, 9487 bp, Homo sapiens
  Payload ID: 11360
  Gene Symbol: NFIA
  Gene Name: nuclear factor I/A
  Uniprot ID: Q12857
  ENST ID: ENST00000403491
  CDS Start-End: 485-2014
ggccgcggaggctcgggacccggctggccgcgcggcgccgcagccgccccctcccccacaccccctcccccccgcggcggcggcgcgagcgggcggcggctgtgcggtgcggtgcagagcggaggcggaggcgggcgcgcgggcagctcgcgggcacccggccgggccggcgcgggagcgggaaagggtgcgctatgcctttaacacccgcgtacagtaggcatgtatagtggagtgtagggaaactctaggcggggttaaagttcagctcatggagcggcaatagcgctggctggctggctgcagttgagccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcatatgtgtctgataagtggttgaatagtcgtttggcgctgttgtatggtgtgattgtcagtgtatggtgtcacttcctatagccagccagcatactttgccttcccctatagcacttagctgggcattactttattatgacatatgtgcactaaaaaatgaaaaaaaggaaaaaaagaaaaaaaaaaagaaaaaatagcagctttcagtgcttcacagtgaagggaaaaaagcctagacaaacattttgtcagaaccttgcaataagccaaggtattaccagtaaattggttgtatatacaataaaattgcacccttttttaaacaaaacaaactaagcaatagtttgggcagttttagttgtttttagtgagcatgttgtagtcatgactgcaaagagagagaataaactgcccgctcagaagatatgtaatttgtattgttgtatagttttattgattacactgatttattctaccctattttataatgcaggacttttgtaatgttgtttaaatgaggaaaaatttctgtcaaattagcctagtaaaatttctgatcgttcattataaaggcagcgttcatagaattgcttttctttctttttaccccccctttgggaactggatttaagtttaaaactttcctgtttcctttttttttttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaactctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcgccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgctatggaa

SEQ ID NO: 160355 - DNA, 2123 bp, Homo sapiens
  Payload ID: 11360
  Gene Symbol: NFIA
  Gene Name: nuclear factor I/A
  Uniprot ID: Q12857
  ENST ID: ENST00000407417
  CDS Start-End: 353-1858
gtacaatccaaagcacgcaaggcaaaaccagagcgaatctgagaaccagccagcccgggttggatcgctttcaaaagagagagtgagagcgagcgagcgagcgagcgagagcgagacagtgagagagggagagagcgcgccttgcaattgcaaaagccttctgatttggagttaaaaaaaaaattctccaagaagcctgcaattggccaacagctttttaaaaaatctcttccgggttttcaacggttccaagtttatttagatattttttaaatgcaaaaaaaaggggacaacaaatgaagcaattcgtctgagcattttaaagtttctcacgtactctttttacattgcaatggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgt

SEQ ID NO: 160356 - DNA, 1674 bp, Homo sapiens
  Payload ID: 11360
  Gene Symbol: NFIA
  Gene Name: nuclear factor I/A
  ENST ID: ENST00000485903
  CDS Start-End: 70-1470
cacccacactcacgcacacctccaaaccgcacacccagacgcacacgcataccccagcgcccggcagttatgtattctccgctctgtctcacccaggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacagacaccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggattttttttttt

SEQ ID NO: 160357 - DNA, 603 bp, Homo sapiens
  Payload ID: 11360
  Gene Symbol: NFIA
  Gene Name: nuclear factor I/A
  ENST ID: ENST00000496712
  CDS Start-End: 1-286
gaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcaggaggagttggaagatgaggagtaacacaacactttagatatacatgttaaaaacttataacaaatcatagatcatactaaaggattaccgaagtttagaacatggctgagggtatagatgtcagattttcttacacaatagtgggtcttttgtttcagagttcactcttggcaagcaactccctaccactgcgttaatttcctgtcgatctttcattcagcaacagacctagagatggggagcagacactgccccccccacccaggctttttaagactgtgctttgtgtagattaaaaagacgaaggaaaaaagaataaactttttccaaacaa

SEQ ID NO: 160358 - DNA, 730 bp, Homo sapiens
  Payload ID: 11360
  Gene Symbol: NFIA
  Gene Name: nuclear factor I/A
  ENST ID: ENST00000476646
  CDS Start-End: 172-730
atctgatccaggacaactcgcccaggagcccggcgggtttcagctgccaccacgaaagatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagattcaagtcaatctgaaagtcccagccagccaagtgacgctgacattaaggaccagccagaaaatggacatttgggcttccaggacagttttgtcacatcaggtgtttttagtgtcactgagctagtaagagtgtcacaga

SEQ ID NO: 160359 - DNA, 3200 bp, Homo sapiens
  Payload ID: 11360
  Gene Symbol: NFIA
  Gene Name: nuclear factor I/A
  ENST ID: ENST00000357977
  CDS Start-End: 10-483
ataaccctgatgttttcttttcctgcagcaagtccgcatgcaacaccatcgactcttcatttcccgacatcacccattatccagcagcctgggccttacttctcacacccagccatccgctatcaccctcaggagacgctgaaagaatttgtccaacttgtctgccctgatgctggtcagcaggctggacaggtggggttcctcaatcccaatgggagcagccaaggcaaggtgcacaacccattccttcccaccccaatgttgccaccgccaccgccaccaccgatggccaggcctgtgcctctgccggtgccagacacaaagcctccaaccacgtcaacagaaggaggtgcagcctcccccacgtcaccaacctactcgacacccagcacctcccccgcaaaccgattcgtcagtgttggaccacgggatccaagctttgtaaatatccctcaacagacacagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcata

SEQ ID NO: 160360 - DNA, 552 bp, Homo sapiens
  Payload ID: 11360
  Gene Symbol: NFIA
  Gene Name: nuclear factor I/A
  ENST ID: ENST00000482020
  CDS Start-End: 1-552
caccaatagctgcaggaactggcccaaatttttctctctcagatttggaaagttcttcatactacagcatgagtccaggagcaatgaggaggtctttacccagcacatcctctacgagctccacaaagcgcctcaagtctgtggaggatgaaatggacagtcctggtgaggagccattttatacaggccaagggcgctccccaggaagtggcagtcagtcaagtggatggcatgaagtggagccaggaatgccatctccaaccacactgaagaagtcggagaagtctggtttcagcagcccctccccttcacagacctcctccctgggaacggcgttcacacagcatcaccgacctgtcattacaggacccagagaattcaagatggctcccagcatcctcggctctcctttctggaaagtctactcagcaagtccgcatgcaacaccatcgactcttcatttcccgacatcacccattatccagcagcctgggccttacttctcacacccagccatccgctatcaccctcaggagacgctgaaagaatttg

SEQ ID NO: 160361 - DNA, 696 bp, Homo sapiens
  Payload ID: 11360
  Gene Symbol: NFIA
  Gene Name: nuclear factor I/A
  ENST ID: ENST00000493627
  CDS Start-End: 1-142
cacaaagcctccaaccacgtcaacagaaggaggtgcagcctcccccacgtcaccaaggtgccacatgacaggacgagtattatgggaaacattgatctcactccgatggtgtggacctgagcagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttt

SEQ ID NO: 160362 - DNA, 1274 bp, Homo sapiens
  Payload ID: 11361
  Gene Symbol: NFIB
  Gene Name: nuclear factor I/B
  ENST ID: ENST00000380921
  CDS Start-End: 447-1049
gcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaaggtaagaatttcttttcttcaaataaatgcatcaagatatagatgtccttgcattaccaacaatccatagtaaaacaatcattttacaaagccgcataccaaaagtagactgaagtttgagctgtcacagatggtaggtcatttccaaacttggcctggtgggaggaaaaatggcctgcagatagccaggtgacagactgttacctgaggtttgttatataaatgtgggacttaataaactgctatgagctttattattcaaaaaaa

SEQ ID NO: 160363 - DNA, 840 bp, Homo sapiens
  Payload ID: 11361
  Gene Symbol: NFIB
  Gene Name: nuclear factor I/B
  ENST ID: ENST00000380924
  CDS Start-End: 329-835
atgaacagcacactgaggaggacacaaaagaagtagacagaatctctgcctctgcttaggagtatgcaatttagttggggcgacaaaacttaaatgctagaaccaataaaagaagattacaaagcaactcgcaaattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttgg

SEQ ID NO: 160364 - DNA, 2142 bp, Homo sapiens
  Payload ID: 11361
  Gene Symbol: NFIB
  Gene Name: nuclear factor I/B
  ENST ID: ENST00000380934
  CDS Start-End: 353-1693
tattgggcagtacaggtctagatgatcaaatgcctacactgaatgacttcatagaatatcactgttgagctgacaccgatctaaaagattcacatgtcggagcaagactgttagtggagtaaactcctcgagtgtacaggacccctttgttcttgttctattttgtttttaacagcttgctctgctccataaagatccatcagtcaccctcaaactcttcggaccttctgcctgttcattcctatgaagctgcgtttgctaaggtactcggtgacctggagcaaacattctaaaacagcgcaaatggcagaagcagagcctacaggcttcttgtcgggaatccgttcggagtatggaaagaatcccagtgtctgtggacttctgggttgtctgctgtgcagttctgaaatgtaaccctgggattcctaaaagaatgtcaactctgtgctttggattttctgatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagcta

SEQ ID NO: 160365 - DNA, 2381 bp, Homo sapiens
  Payload ID: 11361
  Gene Symbol: NFIB
  Gene Name: nuclear factor I/B
  Uniprot ID: O00712
  ENST ID: ENST00000380953
  CDS Start-End: 157-1641
ctgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaa

SEQ ID NO: 160366 - DNA, 8198 bp, Homo sapiens
  Payload ID: 11361
  Gene Symbol: NFIB
  Gene Name: nuclear factor I/B
  Uniprot ID: O00712
  ENST ID: ENST00000380959
  CDS Start-End: 475-1737
gcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagatttaaaaaaaaaataatgtatgcttttttgtttgtttgtttgttttaattgaccaaagtgggtactgctatttttgcagtgtgatgaggtccttttgtgtactgagagatggacaggggattttttttaatatacatatatatatattctggggtgggtgggaggatttttaacactttgcagtgtagctgtgaagcagtgcaccctgagatgggcctgggctgcaaagcgactgttctgcctactgtgacaaacttcaacttacacaggttcccctctctaacttcccacctgggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttatctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagtttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacaga

SEQ ID NO: 160367 - DNA, 2869 bp, Homo sapiens
  Payload ID: 11361
  Gene Symbol: NFIB
  Gene Name: nuclear factor I/B
  ENST ID: ENST00000397575
  CDS Start-End: 559-2244
ccgggatcctgccgcagtgcttggggctgtaaccttgaactttcccagcgcggtgacacattctccccgctctccctcccgcccgcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaa

SEQ ID NO: 160368 - DNA, 3129 bp, Homo sapiens
  Payload ID: 11361
  Gene Symbol: NFIB
  Gene Name: nuclear factor I/B
  ENST ID: ENST00000397579
  CDS Start-End: 1072-2535
tcgagcggggtccagagggtggaaccggtgaatttttcaacttccaagttttgcaacgaaagaaagcaagagagggagggaaaaaaaagagcctagagcagaaaagagaggagtttggagccgagcgggagagcgggatttatcgtttggaatttttcaggagatcgttttgatacccctgggctctgggcagcggcggcaacagcagcctccacgctcggccgggtcagacgcggggcgaggcgggcgggcgggcggccgggcgccgaagacccggcgcgggcggcggcggctgctgctgccggggaccacgcgccgcgagcctcttccgccccagagatcagcgctcgcgccccctccctcaccccggcctctcccttctcccccatcccaccccgcccccaccccggccctctcccgcgcgcgccccgccacccgcgcgcactcgctcacgctgcccctcgcgcacacacatggtcggctcgcggcaaagtttcgcctgcgatcaccactccgggatcctgccgcagtgcttggggctgtaaccttgaactttcccagcgcggtgacacattctccccgctctccctcccgcccgcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaa

SEQ ID NO: 160369 - DNA, 3318 bp, Homo sapiens
  Payload ID: 11361
  Gene Symbol: NFIB
  Gene Name: nuclear factor I/B
  ENST ID: ENST00000397581
  CDS Start-End: 1009-2721
aagcaagagagggagggaaaaaaaagagcctagagcagaaaagagaggagtttggagccgagcgggagagcgggatttatcgtttggaatttttcaggagatcgttttgatacccctgggctctgggcagcggcggcaacagcagcctccacgctcggccgggtcagacgcggggcgaggcgggcgggcgggcggccgggcgccgaagacccggcgcgggcggcggcggctgctgctgccggggaccacgcgccgcgagcctcttccgccccagagatcagcgctcgcgccccctccctcaccccggcctctcccttctcccccatcccaccccgcccccaccccggccctctcccgcgcgcgccccgccacccgcgcgcactcgctcacgctgcccctcgcgcacacacatggtcggctcgcggcaaagtttcgcctgcgatcaccactccgggatcctgccgcagtgcttggggctgtaaccttgaactttcccagcgcggtgacacattctccccgctctccctcccgcccgcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaaggtgaggcagcttcacctacagcaaccacctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaa

SEQ ID NO: 160370 - DNA, 7622 bp, Homo sapiens
  Payload ID: 11361
  Gene Symbol: NFIB
  Gene Name: nuclear factor I/B
  Uniprot ID: O00712
  ENST ID: ENST00000543693
  CDS Start-End: 339-1268
attcacagccatgaacagcacactgaggaggacacaaaagaagtagacagaatctctgcctctgcttaggagtatgcaatttagttggggcgacaaaacttaaatgctagaaccaataaaagaagattacaaagcaactcgcaaattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagatttaaaaaaaaaataatgtatgcttttttgtttgtttgtttgttttaattgaccaaagtgggtactgctatttttgcagtgtgatgaggtccttttgtgtactgagagatggacaggggattttttttaatatacatatatatatattctggggtgggtgggaggatttttaacactttgcagtgtagctgtgaagcagtgcaccctgagatgggcctgggctgcaaagcgactgttctgcctactgtgacaaacttcaacttacacaggttcccctctctaacttcccacctgggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttatctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagtttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacagactctg

SEQ ID NO: 160371 - DNA, 591 bp, Homo sapiens
  Payload ID: 11361
  Gene Symbol: NFIB
  Gene Name: nuclear factor I/B
  ENST ID: ENST00000493697
  CDS Start-End: 92-591
agagaagagaaatgaactgtggcatcgctcctgccttctgaacagctctactccgattaaaaaaaaaaaatctcactgtgttctttgtaaaatggtactgcatagtgatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatc

SEQ ID NO: 160372 - DNA, 557 bp, Homo sapiens
  Payload ID: 11361
  Gene Symbol: NFIB
  Gene Name: nuclear factor I/B
  ENST ID: ENST00000606230
  CDS Start-End: 381-557
acatacatgcacacacgcacacgcgggcgcacacacacacaccatcctggacggcgttcaagtcaagcacgagaaacagccttctgcaagggagaggaaagaaagctggaaatccagacagactgaagggctgcctgcttttagacttgactttgaccgccttttcttctcgggccaagaactgtggcagtgcagaaattacaattaaaaaatacataagactactcccggattgcttttttttttttttttttttttttttaactaaacacaaaaagcgacaccaaaacaacccctgagaaaatccacaaatctgtacctgagacacgtcaagtcagcggcccagggttctgttacagactcaagatctcttttatttaatgcaatacagtgcgatggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagt

SEQ ID NO: 160373 - DNA, 1274 bp, Homo sapiens
  Payload ID: 11361
  Gene Symbol: NFIB
  Gene Name: nuclear factor I/B
  ENST ID: ENST00000622520
  CDS Start-End: 453-1019
tcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaaaggtaagaatttcttttcttcaaataaatgcatcaagatatagatgtccttgcattaccaacaatccatagtaaaacaatcattttacaaagccgcataccaaaagtagactgaagtttgagctgtcacagatggtaggtcatttccaaacttggcctggtgggaggaaaaatggcctgcagatagccaggtgacagactgttacctgaggtttgttatataaatgtgggacttaataaactgctatgagctttattattc

SEQ ID NO: 160374 - DNA, 1573 bp, Homo sapiens
  Payload ID: 11362
  Gene Symbol: NFIC
  Gene Name: nuclear factor I/C (CCAAT-binding transcription factor)
  Uniprot ID: P08651
  ENST ID: ENST00000341919
  CDS Start-End: 89-1375
gggggggcgggggggtggtttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaa

SEQ ID NO: 160375 - DNA, 1755 bp, Homo sapiens
  Payload ID: 11362
  Gene Symbol: NFIC
  Gene Name: nuclear factor I/C (CCAAT-binding transcription factor)
  Uniprot ID: P08651
  ENST ID: ENST00000395111
  CDS Start-End: 37-1329
gctccggcgccggcctcgcctcctcgcagcagcgccatggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcggg

SEQ ID NO: 160376 - DNA, 1716 bp, Homo sapiens
  Payload ID: 11362
  Gene Symbol: NFIC
  Gene Name: nuclear factor I/C (CCAAT-binding transcription factor)
  Uniprot ID: P08651
  ENST ID: ENST00000443272
  CDS Start-End: 52-1578
aagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaa

SEQ ID NO: 160377 - DNA, 1221 bp, Homo sapiens
  Payload ID: 11362
  Gene Symbol: NFIC
  Gene Name: nuclear factor I/C (CCAAT-binding transcription factor)
  Uniprot ID: P08651
  ENST ID: ENST00000586919
  CDS Start-End: 1-1221
atggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgcctactctccgcccgacacgtcccctgcaaaccgttcctttgtgggattag

SEQ ID NO: 160378 - DNA, 8068 bp, Homo sapiens
  Payload ID: 11362
  Gene Symbol: NFIC
  Gene Name: nuclear factor I/C (CCAAT-binding transcription factor)
  Uniprot ID: P08651
  ENST ID: ENST00000589123
  CDS Start-End: 121-1620
gctcgctccctcccccgcgcgccctccctcgccgcctcctcccgccgcctgcggcccccccctcgccggggaccgagcgcgctcgctccggcgccggcctcgcctcctcgcagcagcgccatggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagccgggctccagaggggtcagggcgcgacgagaaccaactctttacctaactttgcatggtgcttagtcaaggactcctgcgacctggctcccgaggtcagctggcggcgctgacacacatgcatggcagactatccctggctctatctccctgttcctcgccccctccaccccccacttcctctttaaaaaaaaaaaaaaaaaaaaaaagatacaagaaaaacctttaaaaaaattccatgtttcctaatttgcacgaaattttctaccacaagatgtgccttgccttccgagaataagtattacctttaaacaatatcagcgcacacacatagctgcatgttctgctcgtgtagtttaaaaaaaaaaagacaaaacagtgacatgaaataaaaaataaaaattgaaaagggatgtatttctatttgtaaaaaaaataaaataaaaaataagaaagtgagaatctaaaaaaaaaaaaaaaaaaaaaaaaggaagaaaaaccacgctaaaaatcaagccactgaaaacaattgcccccaggtctacccagcccctggctgtccttggtcctgtctcccctcctgctgtattcaggggtgccccctggtgctcagcctctaccacccccaaccctgctcttgggtacccagaggggtcatttctgaatcccttgcccagaggacagacctccggggcccatcttggccctgggaaagggctctcctctctgattggtccctaggccacgggccggcccccagacaccattcaccgacccactgcaggctgtcctccaaccatggggtggccactccacccgcagccagactccccgctccccacttttcatgcaggctggcatacccctggctcagggtcaaatgctgttccacacccacctcagaggcaccccctctcccctgccccgtgcatccccacccttcttgccaaaggacctcttttcccctatccagagaccaccccaggtggcattctctcccaccttctcctttgtcccccatcccctgtctctgtcttccagctgtgaatatgaagggtatcctgtatgaaacaaaaacaaaacctgatatatgcaatatctgtctgtctgtctgtacccatgggcctggctcagccattggaggcccagccgagggtccggcagggcacagggacagccaggtggcaccgagtcacaggctgtggtccggtggctgagcatgctgttgtcttgtccttgattttattttcttttgttctttttttttttcttttctttttgtttttaactccagcttcctttgctttttacttgaccaaagctaagacaatagccagatggttagtggggcagccaggcagggaggacccagggctgggattctccaaccttaggccattcctgcagccctcaccacctccagcccctccaagcatctcgtgtagggacccacgcagatggtcccattcattcactattgcccccaaccccgggattttgggtggtctccacagccaccatcatacactcatcccgtgttttcttccaaaaagtcacctcagcagcctccccaggcgatacagagggagagcccagaccaccacagctggccacgacattgcccttaagtaatatgcattggccagagagcccgggctggctgtgcacagcattcatgtagctgatttctagctttttttttttttctgccccactcctgagcaaatctgtcttgccaaggaactaggagcaaccggaggcaaagggagtgggtggccccatcactattgggaccatcgcgtccctgcacagcccacacccgggggcccagagtcctgggctggacgccacccttctcaccccgagcttgcctccttggctcacttggcaccttggctgagtacagcaggcaaaagcccataccaggcagcatgttgtggatggtttagttctccccgcctccctgtttcttggaaaagctacagggtccctgtagggcaaaattcccaggcgccttgctgcagacagagtaagacaaaaacaccaggaagcaggattccgtgcccatctctgcagtttgggttcacaaaagggggtgccgtcatccctgggtggaggagggagtgttggttttttgtttttgtttttttaacatgtatgaaactgacatcttctcaaatcttgttccacccccctctggaagcccccatcacccacccctgctatggacaccacacctatgccaggcccccccccccaccccagtctcattctggggtctgcccatgctgtgggaaagaatagggaggcctcccaaatatatgcaaattgtccccattccgtgggggcacctgacaatgacccgggtggagatggggcatggaggagtaggaagacccagccctatttgactggggagaggaggatctggagtccttcatgcccaggtctggaacccaggttctgaccccagggccccaccctgggctggacaatcagatcccaaaggaatgccaaaggggactcggttgggagagccgcttaggggccagacctgggtccccctgcaggtccccaggcagcagacaattccaccttccctgccccaggaccttgagagacagcagcattccaggcacagacagacttggctgcaccccactgtcccttgcaagacaggttctggagccaggagcaactgtccagccctccagaagagacagcaagcagcccccctacccactctggcctccccaatggtactttgacctccagtgtagggctatactatacatatatatatatatatatatatatatatataattttggaatttgtttctcataatacagaatatatagtggctaccttgtatcttggtctggattctctctctgagaccccggattttactttctctttggagggcgctgggacatacatctctcaatccagcttcctccgcatcctcccatcttgccccatttctgccacgtcagacacttcctgagagtctcaccttcaaaatgacaccgctgcccatccattgctcaatggtacagagtgtggggtcagtccaccacccttgacctcccggcagggcaaggtgaggaggcggacccaaagcagtaccagcaggacttgttgccagtgataccaaaacagacttttcccaagcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccctgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattacgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaacaaaaaaaaaagaaaaaagaaaaaaatgtataaaaattaaacaagctatgcttcgactctt

SEQ ID NO: 160379 - DNA, 1558 bp, Homo sapiens
  Payload ID: 11362
  Gene Symbol: NFIC
  Gene Name: nuclear factor I/C (CCAAT-binding transcription factor)
  Uniprot ID: P08651
  ENST ID: ENST00000590282
  CDS Start-End: 55-1374
agtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccgg

SEQ ID NO: 160380 - DNA, 1727 bp, Homo sapiens
  Payload ID: 11363
  Gene Symbol: NFIX
  Gene Name: nuclear factor I/X (CCAAT-binding transcription factor)
  ENST ID: ENST00000358552
  CDS Start-End: 66-1277
cagacggacactgtgccggggcgagctgacaggagttcacggctgcgatagaacatggagatgtcatgggcgcgacagagcctggcggggataccagcagcgatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccgcccccgtcactgcgcttctgttataccatctttgcctgactctctccggcttctccattgaatggctaatgtgtatgtg

SEQ ID NO: 160381 - DNA, 5459 bp, Homo sapiens
  Payload ID: 11363
  Gene Symbol: NFIX
  Gene Name: nuclear factor I/X (CCAAT-binding transcription factor)
  ENST ID: ENST00000360105
  CDS Start-End: 66-1277
cagacggacactgtgccggggcgagctgacaggagttcacggctgcgatagaacatggagatgtcatgggcgcgacagagcctggcggggataccagcagcgatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttccctccctccctccctccctccctctctgccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttgggtcttttgctgttggaatgggaactcctcctccatttgagcaacttgggaacaatttggtaacacaccacaggaagtagctctcccccccagccccctcctccctcaagggagggttggggggcctgtccagagggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtgcctctctctttctctctctttcttaattgtatgaaaacacaaagcacaggtcaggatcctctgagagaaaatcaacattgcaccacgtaggggtgggctatgggctgtatttattgtgaatctagtttgtgaggctgtggccccgagctggcggagggagggaagaggagggagtgacgggaggggaggaggtcagcgacctggggccgtagcggcaggcgaacggtgcctgctacccagctggaagccacaaggtggctggctccaggggcggcttttgttggaagttgagtgaagccctccccctgtcctcagcgtgcagccctagaggaccccagggctgaggggcagtggatcctgcgggagtctcccggggcgtggggagtaaggccccgggggtggggggccgggtgggccgggcgtgacgcgcggtcaaagtgcaatgatttttcagttcggttggctaaacagggtcagagctgagagcgaagcagaaggggctccctgtccggcccacgtgccctttccctcgacgacagtcgagggctcgggctctgtgggactgtgggagctagggtctgcggggcgcctgcccgggcgaggtcggaagctgcaggccagctgggcccgggccggagcgtgcccggcggggctgcccgggcgggcagggggtgggggctgctcctttcccaagtggtgttgtgaggggcaatgagggcaacaggagatgtggggacgtgttaggagagaaaaaaaaaaaaacaaaaatatatatgggggaaattaacttttttttttcattgaaccaagtgcaatgcatcagagagttttcctatctttgtatgttaagagattaagaaaaaaaaattctatttttgttgtaatgtcctcgcggctctggggacgctaaaagaaccgggcctgccccgccctgcgcggggataacgaaagctgagtgtttttcccttttttttgttcgtttttagtttttttttttttaagtcgttttcctgcgttgacgaggatgatctggggtttttatttgtttcgtcgttcgttctgtttcggtgggagggctgaaggaaacgttcacattttagagtttaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttgttaggaatacgcatatcccttctttgttgagtttaacggaacgggacagcggcgtgcccccggcggctggactgctccggccgcgggtctccccgggcgcccctccctggggcccagcacccctcctcgccccatccccgtccgggtacgggggcgcggcaggggtccccggcccctcccccgcagaggtcaatgccaacgaacaaacgtcccctccctccctccctctccgccccgagcgcccttctttgagccagacgccaacttgaccctcaccagcattatcaggagcgcgctcagcaagttggtagtttcctcccccctttcccggcgcccctcccgcccccattcaacatctctcatcctatccccgaccccctccggggaacaccgggaaggctcgacgctccaggacaggaccagccacgctgacaggtcgatttgcccaggcccgcgcccgcacgcacgcacgcacacggccccgcacacagccccgccccaccccgcaaccagccctgtcgactgccttatacacccgcccccgcgctggccggccgacctagtgccttgttctcacccccgtgctggcggagcggacgccgcgctctgggtcccagaggggccgggtggctcagacgacccaccactcccccaccctgaccgtgctgaacagacccccccacacgagagaaaataaaggagcaataaagtcacgagaactttcgtcccccaatcgagagcccgaggggcaccccagccccgcctctgctcccccccaccccacccaccctcggggcgcccccctccccccgcaagccagcctgggccagccccgcttcggcccctcccgggagatccgtgcgcccgaccagcaccagcatcgcggaccgcaaaggccgcccgtcccgtcaaacaagtttcttcttaggctaagaaacgcagtatatacgagtatctctatatatagtactaatggatttggtgtgcttcccccttagcgtccccctccctctgctcctcctccttcagcctggtctccccctcttctctgccctccacccccgtctctgcactgagatacataagaaacaagggtagtttactgtctgttttgttttctgggttttcagtgtcctagcggaatgcaagtaggcagccagcccgtctgttccctctccgccccgccccgccccgcccccgtcactgcgcttctgttataccatctttgcctgactctctccggcttctccattgaatggctaatgtgtatgtgaaataaagaaataaagaaaaacaaacgcga

SEQ ID NO: 160382 - DNA, 3143 bp, Homo sapiens
  Payload ID: 11363
  Gene Symbol: NFIX
  Gene Name: nuclear factor I/X (CCAAT-binding transcription factor)
  Uniprot ID: Q14938
  ENST ID: ENST00000397661
  CDS Start-End: 231-1556
gcgagcgcggcggcggcggcggcagcggcggccccggagccggcggggccgagcttgcgagcggcgagcgcggagcggcgccgggccgagcgcggggccgcgggccgggcgggcgcagcgcggcggaggccggaggagccgagccggagcccgagcccgagcgcggccgccgcctgccgggcctcccctcgccgcggccggccgccgcgctcccgcccgggcgcccagctatgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattacacgtcgtcagccactcagcccttctctcctccagcccggggacccccgcgggccccagaagcagcccagttctcagagagcccttggaaggggtctcggtggagctgtgcaccagcagccaagcagaaagaaacacgcgacatggactctgtcaagtagaggacagaaagcaagaaaggatgcagaactgccttcctccccctgaccccgccccggccttctggggaaggaacaaagtccccaaacaaagcaaccagcacaattctgaaggggcctggcctccaccctcaccccttcctaggggaaccccaccctccacacagccggagctgccctagggagcctggagggccagcttgtaaagatgatggggtttagatccctcaggctctcccctccagactccgcccttccctccctccctccctccctccctctctgccaaggctccagcttcttcccccagctgctcccgaccaggagggggagagcagcctccacttaccccaccccacccttgggctaaaagcccccaggcgggcagggggtgacccctggagctagttgcgtgtcccagaatggagggtgttctgacaccccaccctgagccgcaagagcagtcctggggccctggacccctctgtacagtccgtaggaaaaagtcggaatgctctcgacggcctcgtcccagcctgggacaggccccctttcccctctctctgcaggccaggagggcctccttcctgccacgagggaggggagtcgggccccaggtcgcccccgcccccagccctgcatgcaggtgccctcgctccgccccatcagttcctgcccctgcccctcatgcagactgccctgctggggccgggccggagggtggagcagaaaggggaccccggagccgagcgaggaggaccaggcagccgccgctgccgcgctaagccaccacctgcgcttaggtaggcgtcctgctcgccgactttcagttccttgggagggtgttgggtgtcgtccttttcaaaagtgttttggagctttctgtgccccccgactttcccccgcctccccgccccccacgtggccacttttctctggattttagctgtaatgtctttactctttatttaggggtggggcattcattgtttgggtcttttgctgttggaatgggaactcctcctccatttgagcaacttgggaacaatttggtaacacaccacaggaagtagctctcccccccagccccctcctccctcaagggagggttggggggcctgtccagagggtcttcagaagcccccctgggagggaggggaggatgagcacgcccagctcccctccagggtgtgacttggcccctctggcttgtctttctgtgccttactcctcctcctgcgtctcccgttcctggccccttcttgagtccttgtg

SEQ ID NO: 160383 - DNA, 582 bp, Homo sapiens
  Payload ID: 11363
  Gene Symbol: NFIX
  Gene Name: nuclear factor I/X (CCAAT-binding transcription factor)
  ENST ID: ENST00000591028
  CDS Start-End: 33-582
agttcacggctgcgatagaacatggagatgtcatgggcgcgacagagcctggcggggataccagcagcgtgtgtgtgtggacggcaacgttgtctgtgcgcgtgtgtgatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcaca

SEQ ID NO: 160384 - DNA, 579 bp, Homo sapiens
  Payload ID: 11363
  Gene Symbol: NFIX
  Gene Name: nuclear factor I/X (CCAAT-binding transcription factor)
  ENST ID: ENST00000590027
  CDS Start-End: 194-579
gcatgtaccaggctggctccgacgacggaaccgccatgggtgctgagtggagagtggggaccgcggaccccgggggcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactgga

SEQ ID NO: 160385 - DNA, 1487 bp, Homo sapiens
  Payload ID: 11363
  Gene Symbol: NFIX
  Gene Name: nuclear factor I/X (CCAAT-binding transcription factor)
  Uniprot ID: Q14938
  ENST ID: ENST00000587760
  CDS Start-End: 42-1343
ctcagaatcgggcgttgggctttgccgggtgcttcagatcaatggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaa

SEQ ID NO: 160386 - DNA, 1083 bp, Homo sapiens
  Payload ID: 11363
  Gene Symbol: NFIX
  Gene Name: nuclear factor I/X (CCAAT-binding transcription factor)
  ENST ID: ENST00000585382
  CDS Start-End: 175-480
cgacgacggaaccgccatgggtgctgagtggagagtggggaccgcggaccccgggggcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaagaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggct

SEQ ID NO: 160387 - DNA, 1692 bp, Homo sapiens
  Payload ID: 11363
  Gene Symbol: NFIX
  Gene Name: nuclear factor I/X (CCAAT-binding transcription factor)
  ENST ID: ENST00000588228
  CDS Start-End: 219-1586
agacggacactgtgccggggcgagctgacaggagttcacggctgcgatagaacatggagatgtcatgggcgcgacagagcctggcggggataccagcagcgtgtgatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccg

SEQ ID NO: 160388 - DNA, 1509 bp, Homo sapiens
  Payload ID: 11363
  Gene Symbol: NFIX
  Gene Name: nuclear factor I/X (CCAAT-binding transcription factor)
  Uniprot ID: Q14938
  ENST ID: ENST00000592199
  CDS Start-End: 1-1509
atgtactccccgtactgcctcacccaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 160389 - DNA, 1615 bp, Homo sapiens
  Payload ID: 11363
  Gene Symbol: NFIX
  Gene Name: nuclear factor I/X (CCAAT-binding transcription factor)
  ENST ID: ENST00000586797
  CDS Start-End: 61-240
ggacactgtgccggggcgagctgacaggagttcacggctgcgatagaacatggagatgtcatgggcgcgacagagcctggcggggataccagcagcgtgatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaa

SEQ ID NO: 160390 - DNA, 1537 bp, Homo sapiens
  Payload ID: 11363
  Gene Symbol: NFIX
  Gene Name: nuclear factor I/X (CCAAT-binding transcription factor)
  Uniprot ID: Q14938
  ENST ID: ENST00000587260
  CDS Start-End: 59-1381
tccttctctctttccccctcatcccgtcttcccctcctcccgtcctccctcgccccgcatgctcccggcttgccgcctgcaggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcattcgcaacgacaggcgcctcctctgccaaccggtttgtcagcatcggaccccgggacggcaactttctgaacatcccacagcagtctcagtcctggttcctctgataagatcgacaaaagaaacaacaaaatgagaagaagaggttcctcgaaaggggggagaagaaattttgagaatggaaaaatcccccagcccagcccagccccaccgaaaagcaaaaattac

SEQ ID NO: 160391 - DNA, 587 bp, Homo sapiens
  Payload ID: 11363
  Gene Symbol: NFIX
  Gene Name: nuclear factor I/X (CCAAT-binding transcription factor)
  ENST ID: ENST00000586873
  CDS Start-End: 212-587
atagaacatggagatgtcatgggcgcgacagagcctggcggggataccagcagcgtgtgtgtgtggacggcaacgttgtctgtgcgcgtgtgtgtgagatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatca

SEQ ID NO: 160392 - DNA, 1485 bp, Homo sapiens
  Payload ID: 11363
  Gene Symbol: NFIX
  Gene Name: nuclear factor I/X (CCAAT-binding transcription factor)
  Uniprot ID: Q14938
  ENST ID: ENST00000585575
  CDS Start-End: 1-1485
atggatgagttccacccgttcatcgaggcactgctgcctcacgtccgcgctttctcctacacctggttcaacctgcaggcgcggaagcgcaagtacttcaagaagcatgaaaagcggatgtcgaaggacgaggagcgggcggtgaaggacgagctgctgggcgagaagcccgagatcaagcagaagtgggcatcccggctgctggccaagctgcgcaaggacatccggcccgagttccgcgaggacttcgtgctgaccatcacgggcaagaagcccccctgctgcgtgctctccaaccccgaccagaagggcaagatccggcggattgactgcctgcgccaggctgacaaggtgtggcggctggacctggtcatggtgattttgtttaaggggatccccctggaaagtactgatggggagcggctctacaagtcgcctcagtgctcgaaccccggcctgtgcgtccagccacatcacattggagtcacaatcaaagaactggatctttatctggcttactttgtccacactccggaatccggacaatcagatagttcaaaccagcaaggagatgcggacatcaaaccactgcccaacgggcacttaagtttccaggactgttttgtgacttccggggtctggaatgtgacggagctggtgagagtatcacagactcctgttgcaacagcatcagggcccaacttctccctggcggacctggagagtcccagctactacaacatcaaccaggtgaccctggggcggcggtccatcacctcccctccttccaccagcaccaccaagcgccccaagtccatcgatgacagtgagatggagagccctgttgatgacgtgttctatcccgggacaggccgttccccagcagctggcagcagccagtccagcgggtggcccaacgatgtggatgcaggcccggcttctctaaagaagtcaggaaagctggacttctgcagtgccctctcctctcagggcagctccccgcgcatggctttcacccaccacccgctgcctgtgcttgctggagtcagaccagggagcccccgggccacagcatcagccctgcacttcccctccacgtccatcatccagcagtcgagcccgtatttcacgcacccgaccatccgctaccaccaccaccacgggcaggactcactgaaggagtttgtgcagtttgtgtgctcggatggctcgggccaggccaccggacagcccaacggtagcggccagggcaaagtcccggggtcatttttgctaccgccgccgcctccagtggccagacctgtgccccttcctatgcctgattccaaatccaccagcactgccccagacggcgccgccttgactcctccatcaccttcattcgcaacgacaggcgcctcctctgccaaccggtttgtcagcatcggaccccgggacggcaactttctgaacatcccacagcagtctcagtcctggttcctctga

SEQ ID NO: 160393 - DNA, 13362 bp, Homo sapiens
  Payload ID: 11364
  Gene Symbol: NFAT5
  Gene Name: nuclear factor of activated T-cells 5, tonicity-responsive
  Uniprot ID: O94916
  ENST ID: ENST00000349945
  CDS Start-End: 681-5048
agattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtgg

SEQ ID NO: 160394 - DNA, 13229 bp, Homo sapiens
  Payload ID: 11364
  Gene Symbol: NFAT5
  Gene Name: nuclear factor of activated T-cells 5, tonicity-responsive
  Uniprot ID: O94916
  ENST ID: ENST00000354436
  CDS Start-End: 319-4914
gcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtgga

SEQ ID NO: 160395 - DNA, 13067 bp, Homo sapiens
  Payload ID: 11364
  Gene Symbol: NFAT5
  Gene Name: nuclear factor of activated T-cells 5, tonicity-responsive
  Uniprot ID: O94916
  ENST ID: ENST00000393742
  CDS Start-End: 385-4752
ccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtgga

SEQ ID NO: 160396 - DNA, 14219 bp, Homo sapiens
  Payload ID: 11364
  Gene Symbol: NFAT5
  Gene Name: nuclear factor of activated T-cells 5, tonicity-responsive
  ENST ID: ENST00000426654
  CDS Start-End: 1209-1508
tgcaacggaaacttttggctccacgaacagaaaagcaagagcaaaaactcagttaaatgcgttcttcctccatctttgcctagtccaaaaggaaaaaaaaagaaacagaaaaaagaaaaactgtttggaagagtagcgttgaggtttgctttttacctgtttttcctctagaacagccaggtggattcacatgatccaattttttaattgtcttctatgtcccactccgaataacccggatgccccagcacaatcagagagatcgttttttttaaaaaaaatttcagcctccaaaggtaggaggggagtgttaggggagaaagtactttaattaaaaatcaataactcgaggtttttgggatacggtttgccatttcctaattaagaaatgggtttgacagtccctttgtacacactgctatgcaaaccccaaagggttggcggctgtccgggcgatgacactccggtcccctgcgagaccccgggccagccaggcccgtccgccgccggcctctggggtccgtccccggctcgcgcagacctctcgcttctctcggctctgtctcctgcgctcagctctgctcggggccggccgcctcaggctcgccgccaccaggtcgttgcaaataccttttccctccccggggccccagcgcgcggccacctcccagcctccccccctcccaccctggcagcggggccctttcccggctcaggaacagcagcagcccgggccgcgccggcaggaagcgaggcccatgttgctgctgttccctggcgcgcctccccgccctccgggggccgccacggctcttccgcgctcccgggcacccccctccgcgcctgcgctgtgccccacgggggcggggctcagattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagtt

SEQ ID NO: 160397 - DNA, 2855 bp, Homo sapiens
  Payload ID: 11364
  Gene Symbol: NFAT5
  Gene Name: nuclear factor of activated T-cells 5, tonicity-responsive
  ENST ID: ENST00000567990
  CDS Start-End: 277-636
cgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgggatccctgagatgttcatactctgcattctcatgtgcatgatccttagatttaaaaagggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtggggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagctggtgctttgaatgtaaatgtgaagaaggaaatatctagtccagcaagaccttgctcttttgaagaggccatgaaaggtaccaagtaaattcttctcaaaaatcgtaattgggtgctcctgtatgttttctctagcacaccttactattttgttttctcttaggtacttataatactttgcagggtatcttcatattgtaaaataaatatgtgtttaactttactaaatgtagagacttgttttccaatttgatatttttcttgctgaatatgtttttatatatatatatatatatatttttttttttaagtatattggagtggaggagttttgtttttttttttaattacccaatattaaaagtatatgaggctgggcacagtggttcatgcctgtaatgccagcactttgggaggccgagtcaggtagatcatttgaggtcaggacttcaagacctgcctggccaacatggtgaaaccctgtctctactgaaaatacaaaaattagccaggggtggtggcaggtgcccgtagtcccagctgctcgggaggctgagtcaggagaatctctttaatctgggaggcaggggttgcagtgagccaaggtcatgccactgtactccagcctgggcgacagagcgagaccctgtcttaaaaaaaaaaaaaaagtgaaataaggccaggcacggtgggtcacacctatagtcccagcactttcagaggccaaggtaggaagattacttgagtccagaaatttgagatgataaatatccattggctaataattaaatgcatcatctatagttattgctgaacagatatgggcagcacagtgagaagatttcttgtctctacaaaaaaattaaaacaggccaggcgcagtggctcacgcctgtaatcccagcactttaggaggccaaggtgggcagataacctgaggtcaggcatttaagaccagagtgaccaacatggagaaacccattctctactaaaaatacaaaattagccaggcatggtggtgcatgcctgtaatcccagctacttgggaagctgaggcagaagaatcgcttgaactcaggaagcagaggttgcggtgagccgagatcgtgccaccgcactccagtctgggcaacaagagcaaaactatctccaaaaaagaaagaaagaaaaataggccaggcg

SEQ ID NO: 160398 - DNA, 4914 bp, Homo sapiens
  Payload ID: 11364
  Gene Symbol: NFAT5
  Gene Name: nuclear factor of activated T-cells 5, tonicity-responsive
  Uniprot ID: O94916
  ENST ID: ENST00000566899
  CDS Start-End: 242-4609
cgcccaagtccctctactcgcgagaatctgtctatgatcttctcccaaaggagttacagttacctccatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatatgtaagtattgcattttggcttcttattgaaaagcatcagattttattcttcttaacagatttaggttaagtaatagtagttctaatcttttaaaatgtggctttctcacaagatgatacttttttactctgaataaaattattctgaatgatagcttatggtcatatagttaatacagaccaggccgggcgtggtggctcatgcctgtaatcccagcactttgagagaccaaggtgggcggatcacgaggtcaggcgatcgagaccatcctggctaacatggtgaaaccccgtctct

SEQ ID NO: 160399 - DNA, 6376 bp, Homo sapiens
  Payload ID: 11364
  Gene Symbol: NFAT5
  Gene Name: nuclear factor of activated T-cells 5, tonicity-responsive
  Uniprot ID: O94916
  ENST ID: ENST00000567239
  CDS Start-End: 241-4887
ccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttc

SEQ ID NO: 160400 - DNA, 732 bp, Homo sapiens
  Payload ID: 11364
  Gene Symbol: NFAT5
  Gene Name: nuclear factor of activated T-cells 5, tonicity-responsive
  ENST ID: ENST00000563474
  CDS Start-End: 1-430
aacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcctcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagctggtgctttgaatgtaaatgtga

SEQ ID NO: 160401 - DNA, 653 bp, Homo sapiens
  Payload ID: 11364
  Gene Symbol: NFAT5
  Gene Name: nuclear factor of activated T-cells 5, tonicity-responsive
  ENST ID: ENST00000565301
  CDS Start-End: 1-426
gctatgcaagtggagagctgctcctcagccgtggggaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgac

SEQ ID NO: 160402 - DNA, 5875 bp, Homo sapiens
  Payload ID: 11364
  Gene Symbol: NFAT5
  Gene Name: nuclear factor of activated T-cells 5, tonicity-responsive
  Uniprot ID: O94916
  ENST ID: ENST00000627621
  CDS Start-End: 95-4744
ccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaa

SEQ ID NO: 160403 - DNA, 4642 bp, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENST ID: ENST00000253506
  CDS Start-End: 370-2847
gagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctggaca

SEQ ID NO: 160404 - DNA, 4302 bp, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENST ID: ENST00000318065
  CDS Start-End: 71-2509
cagcgccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctgga

SEQ ID NO: 160405 - DNA, 4595 bp, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENST ID: ENST00000329101
  CDS Start-End: 57-2849
ccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctgga

SEQ ID NO: 160406 - DNA, 3453 bp, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENST ID: ENST00000397790
  CDS Start-End: 599-1660
ctcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctgga

SEQ ID NO: 160407 - DNA, 2832 bp, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENST ID: ENST00000427363
  CDS Start-End: 1-2832
atgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctag

SEQ ID NO: 160408 - DNA, 3558 bp, Homo sapiens
  Payload ID: 11365
  Gene Symbol: NFATC1
  Gene Name: nuclear factor of activated T-cells, cytoplasmic, calcineurin-dependent 1
  ENST ID: ENST00000545796
  CDS Start-End: 397-1812
ggggacggggggaggggcgggggtcacgttacgcggaggacgcgcgggcagcgccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcacctggaggagaagtcatctcatgacaacagaagggaggtggccgggctgagcacgggagacccaccgtgcaggggcctttcatgggaacggcccacacgcagtttgaccccacgcccagcccttctggcacccctggggttcaatactggaagtgccttatttaaccagaccatcagggcatcatagaattgagcattgaatttgctactgtaggagtatttttaggagcagaaactgcaaacacatttcattgtgaggttttaccctctgtatgaatgaagagaacgctggaaggctgcgagaggactctagtatgagtctccaacatttggaacgtttcctgggctgtcacgtacactcctgctgccttacacagtgcattttagaatcttccagtctgtcatctcagctcttttgtaacatgcttcccttgtctgcgcggttgaaaccgtaggcttgttcatagtcgcatgctcgcatctttgtttttaatctggcttcgaacatagcacaagtaacttgaatagcacatcaataggttactggacaaaagcagaaaaacctgttacaggatagcctgcatttgcatgtgtgtacatatctaggcatctatttatgtataaataataacagagccgacgtgtcctcgcccaggagggcttccctgtcagcaataaccggcatccgttttggaacctgcgtctggggctccagtcgctgctcttgctggcgtccatcgccgcctcggacggccgtgcattttctcgtctcacgcagttcgaggaggaccctagaaagccaggagctgtgattgacagtagctgtaggttaccagacggcaacattagaaagtgattgtaaataacatgcaacctaagtgtaatatatttgttcagttataagatgattgtttcacagaagccttaccactctctgcttcatctaagaaaaccaataccaaaaacgccactttaatgctcagccctgcgttgtgtgttttcagatgagttactgttaacaggtaggtttgtgtaggccttgctgggcactctgtacaattagttgcttattacgtatgattactcacagcgatctattgttccatataaccaaaaagcatggtttattcattgaaacacggttgacctgaactcgtgccttaggaattaatgcccccttatggaacctgcctgaattgcacctgcgggtggaggctccggctgtgaagtcactgaacagaacgtcgctgatggagaaagggctcccgcagaaggaacggcctgtaccgtgcgctccggcacaatcgcgtctcttgtgtctcactcacggaaagaaacaacctgaaggccatcccgtcggtctgcacgtaaccgtgaagacgtgtggccgcgtcccacctgcggctgggtaccctgcacccggcactgtaggagtcacgtgcagcctttctcaggggactgtcattgaaaaggaaacgtttgatgtctgtgtcagctgtctttgtagttaggaaatagatccaataaagccgtatttttttgctgga

SEQ ID NO: 160409 - DNA, 2142 bp, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENST ID: ENST00000542384
  CDS Start-End: 1-2142
atgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgtaaatgaaataatacgaaatgacctctccagcacgagcacccactcctag

SEQ ID NO: 160410 - DNA, 4819 bp, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENST ID: ENST00000591814
  CDS Start-End: 296-2446
gcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatgactttcctccggggcgcgcggcgctgagcccggggcgagggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgtagtcctgatgtggtctttaaggatggtgaatgagctttgtgctgggcggacgtccccgagacacttctccaggggtaacttcatctcctgggaccacgggcatccaggctggggcaccttctcctcaacctgcctgcccctcacccgccgtgggaatggctccttttcactcatacaaaaaaaaaaaaaaatcatcttacctttttaacctttagggtgttttcttaaagaaaataccatccagtttgtttcttcagtccctgaaccagtagaagagaaaggcgtcccccacgccatccccggcttcctttgtgggtacaggccactccccccagctcggagaggacagaattagcagtcatcctgaattttactgtattttgtgggtacaggccactccccacagctcggaggggacagttagcggtcatcctgaattttactgtattttgggtaagcttagctaacatcaataatctttttatattgctttttttctaaaaactgcagagattcctgtcatctgagagggaaattacacactgggcgctaattgcaaaagcagctgcgttctcttagtaaaatcagggtgttttggaaggtttccattttctctgaatgtaaacagcatttgtaatagaccagatcctaaggaagcccttgaatccccacgttcacaccaaactgttgggactccttgtttttatcaggcaagctctggaaaggcctctcaagatgtggaaaatggggttttgctgtaaagtcgctgtaccctaagagtgtctgtgagacagagctgcaggggtgatgtgcagcccccagcccagccctcgcggggaagagcctcacgctctgtgacccccaggattgtggggagggcctcatgctctgggacccccgggattgtggggaagagcctcatgctctgggacccccgggattgtggggaagggcctcacgctctgggacccccaggattgtggggaagagcctcacgctctgggacccccgggattgtggggaagagcctcacgctctgggacccccgggattgtggggaagggcctcacgctctggacccccctggggtttacgtggtctgtgccgcccacacttagtgagtccagcccattcttggaacaaagtacaatatatcttacagaagaaaatattttatctttttctgaaaatataatgattgagtcctaattaaacttcaagcatggttgaccagaaattgaatgttttaaagaaaacctaggccttatagagaaggattgctttccagagcagtgcattaatttttttcttatttgctcagcatgcggcagtccccaccgtgggtttgagcagcactgactttagcacagatcacgtatctcagaggcagaaggggcgtgcggggagcgtgcctgcccttcacaggtgggaggtggcggcccccaggaccgtggccacagcatgaagccggtggggctgagccgctcctgctacctccagtccacaccccacctggcagccggccgtcctgtcctaccagccacactcctgcctcgattggccccggctcccctctcagcattgtgcccagcgtggacatctctcctgcaccccctgcccagtgtctcggctgcaccctccaccccccatctgctccagcatggctcaacgcaggccaggttccccaggctcaccctgggcaccagccttcgcccgttctccctctctttgcctccgtcgtctcttctctcctggacgtagcaccatagtccctgggtgaccatcccaggtccccacaagcacactgaccagccccaccagcccccaggggctccccggctccctgtcaccccacctggtcctgggggctgcgaccgcaacctgcaccagactgtgagcccctcaggcagagcccccaggctgccgcagggcgagatccccagtgttgacgctgggcctacctcgaggccactgtcagtgtggttgttaaataaataatgaatagaaaccagc

SEQ ID NO: 160411 - DNA, 2103 bp, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENST ID: ENST00000586434
  CDS Start-End: 1-2103
atgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgtaaatgaaataatacgaaatgacctctccagcacgagcacccactcctag

SEQ ID NO: 160412 - DNA, 2531 bp, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENST ID: ENST00000592223
  CDS Start-End: 60-2171
gaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaataggtatagctattttgcaggcacctttaggaataaactttgcttttaagcctgt

SEQ ID NO: 160413 - DNA, 1919 bp, Homo sapiens
  Payload ID: 11365
  Gene Symbol: NFATC1
  Gene Name: nuclear factor of activated T-cells, cytoplasmic, calcineurin-dependent 1
  ENST ID: ENST00000590313
  CDS Start-End: 62-277
gagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcaggtgagtgcgcctccaagcagtagctgcccccctggtctcgaacactcgctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacgtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaag

SEQ ID NO: 160414 - DNA, 2195 bp, Homo sapiens
  Payload ID: 11365
  Gene Symbol: NFATC1
  Gene Name: nuclear factor of activated T-cells, cytoplasmic, calcineurin-dependent 1
  ENST ID: ENST00000587635
  CDS Start-End: 95-2014
ggctgtcttcccggagacccgaccccggcagcgcggggcggccgcttctcctgtgcctccgcccgccgctccactccccgccgccgccgcgcggatgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacggcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttctaaagacgcagaaacgacgtcgccgtaaagcagcgtgg

SEQ ID NO: 160415 - DNA, 7525 bp, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENST ID: ENST00000371564
  CDS Start-End: 221-2986
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgatttttttttcttaagagaaatgatgtattcttgaaacatttgttactcattccaggaaacaaaaacccatataataaaacccccactcagagcctgttagtcacctctctagaagatggcatctcaggagaaggaatggctttgtggaagaaggaatcacctttttcttgctcaagaattatgctgacttcagccctgagcctggatctggtcactgagaatcatcaagtgtctagatcctccccccaaaataactaatttagtaggtgattttgattttaaaaaattgacaccaaaaccctgcctgcattgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatgtcaaaaaaaaaaaaaaaaaaagacctttccaagtgctttctattgctcagaattgaaagaatgttttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgtttaaaaacaaacttttctggtggttgataacagagagttgctccctgagccatcagggtcctgggagctggaagtgaaagggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagcaacatcta

SEQ ID NO: 160416 - DNA, 7437 bp, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENST ID: ENST00000396009
  CDS Start-End: 221-2998
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgatttttttttcttaagagaaatgatgtattcttgaaacatttgttactcattccaggaaacaaaaacccatataataaaacccccactcagagcctgttagtcacctctctagaagatggcatctcaggagaaggaatggctttgtggaagaaggaatcacctttttcttgctcaagaattatgctgacttcagccctgagcctggatctggtcactgagaatcatcaagtgtctagatcctccccccaaaataactaatttagtaggtgattttgattttaaaaaattgacaccaaaaccctgcctgcattgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatgtcaaaaaaaaaaaaaaaaaaagacctttccaagtgctttctattgctcagaattgaaagaatgttttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgtttaaaaacaaacttttctggtggttgataacagagagttgctccctgagccatcagggtcctgggagctggaagtgaaagggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagcaacatcta

SEQ ID NO: 160417 - DNA, 2974 bp, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENST ID: ENST00000414705
  CDS Start-End: 1-2706
atgcagagagaggctgcgttcagactggggcactgccatcccctccgcatcatggggtctgtggaccaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctcta

SEQ ID NO: 160418 - DNA, 2740 bp, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENST ID: ENST00000610033
  CDS Start-End: 364-2472
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctcta

SEQ ID NO: 160419 - DNA, 2662 bp, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENST ID: ENST00000609507
  CDS Start-End: 286-2394
tctggagtaagccggatcgcggagccgcgccgactccgccgagccgggagccgggaggcgcgcagctcccgggtcgctccgaggctcctcggccagggcagccccgcgggcacgcggtagagaagacggcgtcccctcggctgctggtcgatacaaacagatccccctttccaaacacgcgccaagtccccgtgccctccagatgcagagagaggctgcgttcagactggggcactgccatcccctccgcatcatggggtctgtggaccaagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctcta

SEQ ID NO: 160420 - DNA, 5690 bp, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENST ID: ENST00000609943
  CDS Start-End: 203-2920
tctggagtaagccggatcgcggagccgcgccgactccgccgagccgggagccgggaggcgcgcagctcccgggtcgctccgaggctcctcggccagggcagccccgcgggcacgcggtagagaagacggcgtcccctcggctgctggtcgatacaaacagatccccctttccaaacacgcgccaagtccccgtgccctccagatgcagagagaggctgcgttcagactggggcactgccatcccctccgcatcatggggtctgtggaccaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgta

SEQ ID NO: 160421 - DNA, 4569 bp, Homo sapiens
  Payload ID: 11367
  Gene Symbol: NFATC2IP
  Gene Name: nuclear factor of activated T-cells, cytoplasmic, calcineurin-dependent 2 interacting protein
  Uniprot ID: Q8NCF5
  ENST ID: ENST00000320805
  CDS Start-End: 76-1335
tgcaaggcgaaagtcgctgaagggggcggggcgaggcgagaggaggcgggcgtgtgttgtggaggaaagtgtgccatggcggagcctgtggggaagcggggccgctggtccggaggtagcggtgccggccgagggggtcggggcggctggggcggtcggggccggcgtcctcgggcccagcggtctccatcccggggcacgctggacgtagtgtctgtggacttggtcaccgacagcgatgaggaaattctggaggtcgccaccgctcgcggtgccgcggacgaggttgaggtggagcccccggagcccccggggccggtcgcgtcccgggataacagcaacagtgacagcgaaggggaggacaggcggcccgcaggacccccgcgggagccggtcaggcggcggcggcggctggtgctggatccgggggaggcgccgctggttccggtgtactcggggaaggttaaaagcagccttcgccttatcccagatgatctatccctcctgaaactctaccctccaggggatgaggaagaggcagagctggcagattcgagtggtctctaccatgagggctccccatcaccaggctctccctggaagacaaagctgaggactaaggataaagaagagaagaaaaagacagagtttctggatctggacaactctcctctgtccccaccttcaccaaggaccaaaagcagaacgcatactcgggcactcaagaagttaagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatgtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaagatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaaaaaaaaaatgagctaggtgtggtggcaggcgcctgtaatcccagttacttcgggaggctgaggcaggagaatcgcttgaacccaggaggcagaggttgcagtgagccaagatcgcgccattgcactccagcctgggcgacaagagtggaaactctgtctcaaaaaaaaaaaaaaaaattcagtgaaatacacctttatatatgagatccaagtttcactttttgtgatataatgagccagttttctcagtaatgtctactaaaaaaaaagccattaacctttctctaatatttgcatgattctaataaaagtatgtcaacttcttaaaatgttttattgaaatgtggcattcctttgaattttatgacattaaaataatccacgacatggtacagctcttcactttttcagctttttaaatgtccattaataagtttgaatacgttaaaattatatgtttaacctcaacaaaataaatggcaatatgttcaacttgt

SEQ ID NO: 160422 - DNA, 1157 bp, Homo sapiens
  Payload ID: 11367
  Gene Symbol: NFATC2IP
  Gene Name: nuclear factor of activated T-cells, cytoplasmic, calcineurin-dependent 2 interacting protein
  Uniprot ID: Q8NCF5
  ENST ID: ENST00000568148
  CDS Start-End: 358-741
catactggcccacgttcccacacagtgccaatcagctggagctgcgtaacagccagcctgtctaggtggcatgtgaattccagtttgctgcaatccccaccacccctttctttgttctaacccatggctgctatatttctttgtgttactcgcctgtaccccttgctgacacgattttattctataccttgccaggtaaatatgatgaaactcacagctgaggagcttagcaagtagctaaggccagagcttgtgtttgggtggtgtggctgggggcatggatttcaaggcaggaagacctcttttgcttgttgtccccatccctagtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagca

SEQ ID NO: 160423 - DNA, 2350 bp, Homo sapiens
  Payload ID: 11367
  Gene Symbol: NFATC2IP
  Gene Name: nuclear factor of activated T-cells, cytoplasmic, calcineurin-dependent 2 interacting protein
  ENST ID: ENST00000564978
  CDS Start-End: 93-515
tggaatctttggcgccttggtttcagaggttaaaagcagccttcgccttatcccagatgatctatccctcctgaaactctaccctccaggggatgaggaagtcggagcccctgcagagtgtggtggaccacatggccacccaccttggggtgtccccaagcaggatccttttgctttttggagagacagagctatcacctactgccactcccaggaccctaaagctcggagtggctgacatcattgactgtgtggtactaacaagttctccagaggccacagagacgtcccaacagctccagctccgggtgcagggaaaggagaaacaccagacactggaagtctcactgtctcgagattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaa

SEQ ID NO: 160424 - DNA, 6328 bp, Homo sapiens
  Payload ID: 11368
  Gene Symbol: NFATC3
  Gene Name: nuclear factor of activated T-cells, cytoplasmic, calcineurin-dependent 3
  Uniprot ID: Q12968
  ENST ID: ENST00000349223
  CDS Start-End: 225-3422
gcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgatttgtttaccagtaataattttgacttgcttcagttgagacctacgttttggccagtcccagcaggaagatatctgaggaatctagagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagt

SEQ ID NO: 160425 - DNA, 6040 bp, Homo sapiens
  Payload ID: 11368
  Gene Symbol: NFATC3
  Gene Name: nuclear factor of activated T-cells, cytoplasmic, calcineurin-dependent 3
  Uniprot ID: Q12968
  ENST ID: ENST00000346183
  CDS Start-End: 25-3252
gctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagta

SEQ ID NO: 160426 - DNA, 6144 bp, Homo sapiens
  Payload ID: 11368
  Gene Symbol: NFATC3
  Gene Name: nuclear factor of activated T-cells, cytoplasmic, calcineurin-dependent 3
  Uniprot ID: Q12968
  ENST ID: ENST00000329524
  CDS Start-End: 25-3231
gctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagta

SEQ ID NO: 160427 - DNA, 2484 bp, Homo sapiens
  Payload ID: 11368
  Gene Symbol: NFATC3
  Gene Name: nuclear factor of activated T-cells, cytoplasmic, calcineurin-dependent 3
  ENST ID: ENST00000539828
  CDS Start-End: 242-358
cgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatggtaagttcatctctgatatgttcttgaagtagtgaagattcagggactttattctcccaagtgtcatgaaaaagtttctatggattgcttattggcatatggttgggcttttaaataagttgttattagaaatatatgttaatatataactttgccaggtaccacggctcacgcctgtatcccagcactttggaaggctgaggcgggtggatcacaaggtcaggagttcaagaccagcctggccaacatggtgtaacgctgtctctactaaaaatacaaaaaattagccaggcatggtggtgtgtgactataatcccagctactcgggaggctgagacaggagaatcacttgaacccgggaggtggcagttgcagggagctaagatcgcgccattgcactccagcctgggcggcagagcaagactccgtctcggg

SEQ ID NO: 160428 - DNA, 737 bp, Homo sapiens
  Payload ID: 11368
  Gene Symbol: NFATC3
  Gene Name: nuclear factor of activated T-cells, cytoplasmic, calcineurin-dependent 3
  ENST ID: ENST00000568466
  CDS Start-End: 294-410
gcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaag

SEQ ID NO: 160429 - DNA, 792 bp, Homo sapiens
  Payload ID: 11368
  Gene Symbol: NFATC3
  Gene Name: nuclear factor of activated T-cells, cytoplasmic, calcineurin-dependent 3
  ENST ID: ENST00000561714
  CDS Start-End: 317-433
cggcagggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgct

SEQ ID NO: 160430 - DNA, 3748 bp, Homo sapiens
  Payload ID: 11368
  Gene Symbol: NFATC3
  Gene Name: nuclear factor of activated T-cells, cytoplasmic, calcineurin-dependent 3
  ENST ID: ENST00000562926
  CDS Start-End: 1-3160
cttggatgaccggagaccgataaccctgtgtgtgtgtgtgcgcgcgcgtgtgtgtgatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagcaaaaaaaaaaaaaaaaaaaaaaaaaagaaaaaaaaag

SEQ ID NO: 160431 - DNA, 707 bp, Homo sapiens
  Payload ID: 11368
  Gene Symbol: NFATC3
  Gene Name: nuclear factor of activated T-cells, cytoplasmic, calcineurin-dependent 3
  ENST ID: ENST00000562171
  CDS Start-End: 237-362
gtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccaggtatt

SEQ ID NO: 160432 - DNA, 3181 bp, Homo sapiens
  Payload ID: 11368
  Gene Symbol: NFATC3
  Gene Name: nuclear factor of activated T-cells, cytoplasmic, calcineurin-dependent 3
  ENST ID: ENST00000570212
  CDS Start-End: 1-3181
cttggatgaccggagaccgataaccctgtgtgtgtgtgtgcgcgcgcgtgtgtgtgatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgtgaacgagataattgggagagacatgtcccagatttctgtttcccaaggagcaggggtgagcaggcaggctcccctcccgagtcctgagtccctggatttaggaagatctgatgggctctaa

SEQ ID NO: 160433 - DNA, 529 bp, Homo sapiens
  Payload ID: 11368
  Gene Symbol: NFATC3
  Gene Name: nuclear factor of activated T-cells, cytoplasmic, calcineurin-dependent 3
  ENST ID: ENST00000565750
  CDS Start-End: 1-504
ttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaaggaatccaagatacgttcatcttttgatgtcgtctttgatgcacagcttctactgtccatgggaaagaagaaggtgtatggaaagcactcaagatacttaactacattaacctggaaattactatcaatcatcaccacttacaattttttggctacaagtagtcacatggccctacttacatgcagaagtactgggaaaagtagtccctggctgggcagcctttcctcatcaaaactctgtattctgtagtataatatagaactctatacttaaa

SEQ ID NO: 160434 - DNA, 3824 bp, Homo sapiens
  Payload ID: 11368
  Gene Symbol: NFATC3
  Gene Name: nuclear factor of activated T-cells, cytoplasmic, calcineurin-dependent 3
  ENST ID: ENST00000575270
  CDS Start-End: 339-3482
gtagggggcggggccgggcgcgcggcagggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatggttttgtcaaagcagagaaaccacttagtcatgactgagtcttagcccgaggaagggatgggaaaaagggaggaagaaggaggccaagcaagtgatgaggaagatacgtacatcgcttttgctcacatttcattgaagaaaacgaattgcatgggccatacctagctacactggggaagccaggaaatatactctgtagctgggtgtcagtgtgactaactaaacctcgattactgtggaagaatgaattaagataattagcagcctaccatagataccttctaaattttcaggaacttatttctgtctgtagcttgaaaaatcaaatgaatattttttggtttttcccttttttttgttttatttggagacagggtctc

SEQ ID NO: 160435 - DNA, 4749 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000250373
  CDS Start-End: 142-2850
gcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 160436 - DNA, 5488 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000424781
  CDS Start-End: 83-2827
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 160437 - DNA, 5700 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000413692
  CDS Start-End: 145-3039
gtaaacgtctgacctggggccgtcgcttaaccgtttagttgctgggatggggcggcgttgggggtgcggccctgaaccggagggatttagagactggagacgcggcctctaagagaggttgaaactgtgtgtgtgtgggagaaaatgataaccaccctcccatctctcctacccgccagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 160438 - DNA, 5491 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000422617
  CDS Start-End: 161-2830
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 160439 - DNA, 5686 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000539237
  CDS Start-End: 224-3025
ttccagactacagttctagggaggaggctgccaacttcccgtggaggctaattcacggcccctctgggtggctgggacaagggcagcggcaaagcctggcctggatctacgcccatcaagggctgtgggcctagggacagttctcaaagcctctttggctcggactgctcccagaggcatccaggctggctaagcgttcttcatctttgggggtcctggaggaatggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 160440 - DNA, 2955 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000554344
  CDS Start-End: 457-2955
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaaggtctctttgctgaggggcagggagcatagaaggacttgcggcctggccactcaaggaacatagccatctcacctgcttctctctttccccctctccctctgctcctcttcccattttgacagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctga

SEQ ID NO: 160441 - DNA, 5367 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000553708
  CDS Start-End: 1-2706
atgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 160442 - DNA, 2506 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000554966
  CDS Start-End: 83-2506
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 160443 - DNA, 3169 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000555453
  CDS Start-End: 147-2819
cccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagt

SEQ ID NO: 160444 - DNA, 2631 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000554661
  CDS Start-End: 457-2631
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaaggtctctttgctgaggggcagggagcatagaaggacttgcggcctggccactcaaggaacatagccatctcacctgcttctctctttccccctctccctctgctcctcttcccattttgacagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 160445 - DNA, 1382 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000554473
  CDS Start-End: 393-1382
gggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 160446 - DNA, 3057 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000554050
  CDS Start-End: 322-2706
gaagagaggacagagggagggagggtgggggaggacgaggggcgcgtggttttcccatctcatccctggaggaggggctggagcatccccggcagccaatcagggacaggctgggggggggaccgctttgaagaagtttgggggaaaaaagtttggaaaagtttctataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtg

SEQ ID NO: 160447 - DNA, 2025 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000556759
  CDS Start-End: 393-1706
gggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacag

SEQ ID NO: 160448 - DNA, 2830 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000555590
  CDS Start-End: 83-2830
gaagaggaggggaacccacagggtccggaggtttcaggcccctagtaaacctggcaaggatttttagaagagccggagtgggatgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctga

SEQ ID NO: 160449 - DNA, 5613 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000557451
  CDS Start-End: 457-2952
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaaggtctctttgctgaggggcagggagcatagaaggacttgcggcctggccactcaaggaacatagccatctcacctgcttctctctttccccctctccctctgctcctcttcccattttgacagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 160450 - DNA, 4364 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000555167
  CDS Start-End: 393-1703
gggacaccagcctcatgtctactctggaaaatggtggcccgccagatatgggggagggtttaggctgaggacaaaagtcactgggagttaagttttctctgtattgagttgggccagtctctttggaggctcttctgcctttgcccagcccactttgggctttattccaagaaaaacactgtgaactccaggccatgttttctccacaacgggtgcccagttccccaagggattcccttgcaggatatcctttatctttcaccattcccatcccatggtagactgaaaatctagggatgaataaaggatgagacggtggggatttcaatgaggtggccgctctctccctctgccagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctgttgtgctggaaagctggggacaggttgatggtaataaactgctcaatgaccagtgcttcaggctccagagctctttggagagatgggttggggcagcttactccagccctggcccaaggaggcccagaagttggaaagagatggaatgtggctgggaacattgcatcccaaagagcttctcagtggaggaggctggggaaggcatgagggggctcagaggctccttgactgggaccaggattgggggccagggcttgagtaggcctctccactctcctccttgggggtccagattccttaggagctttgggatgaggcccaggaggctgcatttttccaggtccttagtcttgccaccacacagatgattctgattcatagccaagatgaggacacactgatgtagctgatctctcatttacagaggaggattctaaagttcagagagggaaaggggcttgcctgaggtcacgtagataatcagcagcacattgaacgctgcactcctgggctcctgtccccagcccccattcagacacgctgactcaggaggtccaggcctctaaggcttctctccctggagtgagggtggaggtgagggagagctggcacaagccctccctctggatcctccactcctggggattatgaagatattctggaaagatttgtgcttcagaggtagactgcagaaagcaaacagtctacccagcagctctgaatgtcacctgccctggggcttacagcactatatgagttcctggcctatcctgcaaatatgcccatgctggccttctaaatagctggtacatccatcaccactgacgggcctggcctggaaacctggtttgtcccctgtcttgatggcctacgagaggccaagttccactgggctgggaaaagtcactttgtctgtcttgttcacctggagcctgacacaccgtaggtactgagtacaaatagcttgatttggctaggcttggctgcagggggacgtgcctaaaagacattccgggcatttgcacttgggaaacttgcctcaccttcaggcttgtggggcctctctatgcccaatgagtccaggcagtcctagcaagtactcaggagagcaggggtgggtgtgacagaggctggctctggattgggggacaacagaaccagagtaactcctcgcctgttgctgctttgcaatgaatttcctttacctttctggaacacaagctgctgtgaaccaaactgatatcaagtgattagctcaccgggccttggttgcttttcaaagatccccttcagccccctgccagagtcactgccccataatcaccatgtcagaagggaccctagggcattcgtgtcctatttatcaatcttcagcaccacctctaagatctctgagagagggtggatcagcctctgtgtaaacaaaaagctgttaggacttgttgcctctcaaggtggactattctgttttctgccaggacactgccattcatgcattgtcagatatttattaaacagcagcaaagtgccagccaatttgtcctggaggaattcatagcctcatggggcaaaagtaaataaacagcttattacaattcaacaa

SEQ ID NO: 160451 - DNA, 2509 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000556169
  CDS Start-End: 161-2509
atgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 160452 - DNA, 856 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000557767
  CDS Start-End: 608-856
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 160453 - DNA, 2566 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000553469
  CDS Start-End: 86-2566
agttctcaaagcctctttggctcggactgctcccagaggcatccaggctggctaagcgttcttcatctttgggggtcctggaggaatggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctga

SEQ ID NO: 160454 - DNA, 1476 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000555802
  CDS Start-End: 608-1180
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctg

SEQ ID NO: 160455 - DNA, 2235 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000555393
  CDS Start-End: 608-1177
ctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgctgagggctggagctgggcttttcagagatcgggcatccctggtctctcagggccagttggaggttcccaggaggcatgttcttgatgcctgtggctgcctgaatccaattaactgaattctgaagagtgcatggggtaactgtctcagcctttctcctgtctctgcctctgtcctctgctccaaatcataaaatctcagagctagaagcactttcaagatcattccatccagcgcattcaatttgcaagtttaggcgttgagttccagagagggatggtagcttgctgaggtcccagtcaagcacacttgccattgcctcagctttcccctaaacacggtgtctgtggtcagggttggtgaggaggagctttcctgttttgcctctccttcttcccattggctacacccatctctggccctgctgataccgattcccctgacatttcaggctaagccagcaggaaagggctaggacgggtgcctgggagcccacatggagggagttgggcaagatttgattcggagcaggtgtcaagacgtgttggggaaactgaggcccagtggaatagaagccagtagaggaggaatctagaggcctcctagattaagacctgcctggaatggattgggggtgggtctttggaaaaggaggggacccacctctagcccagtctctcaactgcccctcctttacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggggaaggagtgtgtggaggagggaggagggtgaagactgaggctaggtgccagaatggactggagtgaaggcgtgtctagagtgtgggctggctg

SEQ ID NO: 160456 - DNA, 559 bp, Homo sapiens
  Payload ID: 11369
  Gene Symbol: NFATC4
  Gene Name: nuclear factor of activated T-cells, cytoplasmic, calcineurin-dependent 4
  ENST ID: ENST00000554903
  CDS Start-End: 130-559
tttcccatctcatccctggaggaggggctggagcatccccggcagccaatcagggacaggctgggggggggaccgctttgaagaagtttgggggaaaaaagccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctccta

SEQ ID NO: 160457 - DNA, 573 bp, Homo sapiens
  Payload ID: 11369
  Gene Symbol: NFATC4
  Gene Name: nuclear factor of activated T-cells, cytoplasmic, calcineurin-dependent 4
  ENST ID: ENST00000554779
  CDS Start-End: 156-573
ataataacgagggggcttctggagggaggcggcagcgacggaggagggggcttctcagagaaagggagggagggagccacccgggtgaagatacagcagcctcctgaactcccccctcccacccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggacctctgccctacccccactggactggcctctgcccagccaatatgagcagctggagctgaggatcgaggtacagcctagagcccaccaccgggcccactatgagacagaaggcagccgtggagctgtcaaagctgcccctggcg

SEQ ID NO: 160458 - DNA, 2893 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000554591
  CDS Start-End: 117-2690
aaccgtttagttgctgggatggggcggcgttgggggtgcggccctgaaccggagggatttagagactggagacgcggcctctaagagaggttgaaactgtgtgtgtgtgggagaaaatgataaccaccctcccatctctcctacccgccagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacagtgagtgagatcattggccgagacctgagtggcttccctgcacctcctggagaagagcctcctgcctgaaccacgtgaactgtcatcacctggcaaccccagccccagcctcagccctgccccctttccctccttcctggagtggtggctacagaagcttggggccaaccctggctcctctttccccagcttctgtctgtctcactgtcttccctcccctcccccagctgaggtgtggccctcaggcctggtgctgccttggagggctgggg

SEQ ID NO: 160459 - DNA, 2924 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000556279
  CDS Start-End: 120-2924
atctacgcccatcaagggctgtgggcctagggacagttctcaaagcctctttggctcggactgctcccagaggcatccaggctggctaagcgttcttcatctttgggggtcctggaggaatggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctga

SEQ ID NO: 160460 - DNA, 2707 bp, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENST ID: ENST00000553879
  CDS Start-End: 186-2684
acggttgcgatggcaactggggctcctgccagcgccgtttgggggtttgggaaccgctgctaattgggttcatgtaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaagtgagtgagatcattggccgagacctgagtggcttccctgcacctcctggagaagagcctcctgcctgaaccacgtgaactgtcatcacctg

SEQ ID NO: 160461 - DNA, 904 bp, Homo sapiens
  Payload ID: 11369
  Gene Symbol: NFATC4
  Gene Name: nuclear factor of activated T-cells, cytoplasmic, calcineurin-dependent 4
  ENST ID: ENST00000557674
  CDS Start-End: 315-904
cctccgcccctagatggcgaggagagagggaggagccacctcccctcgtcaccacagccctgacgcccccctcccctctggccacggttgcgatggcaactggggctcctgccagcgccgtttgggggtttgggaaccgctgctaattgggttcatgtgtgagtcgcccccagtccagcccagtgcctcaagaaacacgcctccaggcccagccccagctccagcccctctggacccacctctctcaccttaagacccactggatcgggtaccctcggtcctaggatccaggggccagtgggcaaaggcctggcatgcctgcttcaatctcctccatcttcccagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggc

SEQ ID NO: 160462 - DNA, 4085 bp, Homo sapiens
  Payload ID: 11370
  Gene Symbol: NFKB1
  Gene Name: nuclear factor of kappa light polypeptide gene enhancer in B-cells 1
  Uniprot ID: P19838
  ENST ID: ENST00000226574
  CDS Start-End: 468-3377
gtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctca

SEQ ID NO: 160463 - DNA, 3693 bp, Homo sapiens
  Payload ID: 11370
  Gene Symbol: NFKB1
  Gene Name: nuclear factor of kappa light polypeptide gene enhancer in B-cells 1
  Uniprot ID: P19838
  ENST ID: ENST00000394820
  CDS Start-End: 466-3372
gagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgc

SEQ ID NO: 160464 - DNA, 609 bp, Homo sapiens
  Payload ID: 11370
  Gene Symbol: NFKB1
  Gene Name: nuclear factor of kappa light polypeptide gene enhancer in B-cells 1
  ENST ID: ENST00000511926
  CDS Start-End: 388-609
ggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggaaggaacacaacgtcctacatcaagaaaaaagacagaagcatatcttggagatatgaaaagaaccaccagcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccat

SEQ ID NO: 160465 - DNA, 557 bp, Homo sapiens
  Payload ID: 11370
  Gene Symbol: NFKB1
  Gene Name: nuclear factor of kappa light polypeptide gene enhancer in B-cells 1
  ENST ID: ENST00000509165
  CDS Start-End: 124-557
ggacaaacttgaacacaaaggaacacacgttatatgtacatttaatactggaaccgaaaagctgcttgcagtgaaaagcaaaccacttctaaactctttgagactttttaaagaagcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgt

SEQ ID NO: 160466 - DNA, 3707 bp, Homo sapiens
  Payload ID: 11370
  Gene Symbol: NFKB1
  Gene Name: nuclear factor of kappa light polypeptide gene enhancer in B-cells 1
  Uniprot ID: P19838
  ENST ID: ENST00000505458
  CDS Start-End: 278-3184
gctaaccgctgggctagaccgtgggaggaggttgacagtagctgagaggcacatgggattagcgacagcggggaaagacacatccggacctcgcaggggctagtcggccgaagggccgcggccgcccggcggtcatttctcttcacgtccctccgcggggcgggaacgcgaaccggaggggaactcttacaaacttttaaaatccccaaccccagccccacctgggggatggtgagaaggttggagtgcgctgcggcgcggaggagagagcttcagaatggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaa

SEQ ID NO: 160467 - DNA, 751 bp, Homo sapiens
  Payload ID: 11370
  Gene Symbol: NFKB1
  Gene Name: nuclear factor of kappa light polypeptide gene enhancer in B-cells 1
  ENST ID: ENST00000508584
  CDS Start-End: 163-751
gtccctccccacttctaatcaagtttacatcttgtagccagatagatattactgaagttctgtatcttgttgctgctccgtgtctccgttttgcctacaaaatccaaattctatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccag

SEQ ID NO: 160468 - DNA, 965 bp, Homo sapiens
  Payload ID: 11370
  Gene Symbol: NFKB1
  Gene Name: nuclear factor of kappa light polypeptide gene enhancer in B-cells 1
  ENST ID: ENST00000507079
  CDS Start-End: 371-965
gccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggaaggaacacaacgtcctacatcaagaaaaaagacagaagcatatcttggagatatgaaaagaaccaccagcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggag

SEQ ID NO: 160469 - DNA, 4010 bp, Homo sapiens
  Payload ID: 11370
  Gene Symbol: NFKB1
  Gene Name: nuclear factor of kappa light polypeptide gene enhancer in B-cells 1
  Uniprot ID: P19838
  ENST ID: ENST00000600343
  CDS Start-End: 1140-3506
atacccagactcaaaaccttcccatcctcactgactccccctcctcgcctgtgctgcgaggctgtggtccagccattccgtgctctctggcattccacactacattccattttcattgttccacttatagtagtcttctccctggtctctgtccctccccacttctaatcaagtttacatcttgtagccagatagatattactgaagttctgtatcttgttgctgctccgtgtctccgttttgcctacaaaatccaaattctgtaagttggctttttggatctcccaagagctggcctcaggctgcatttccaatctatttcccgttttgccccttcaggtcaaagtctactacttggtaggagcaccatgatttctcactttcctgccttggcacattctttctatttttgctctctcctcttcctggaatgcctttatccactctcttatatgaatgtgttcaaattctgccaccttttcaatattcagagcaaatacctcttctgctccaaagccctctgaactctctccttctttgaaatcccacatcacttcatttgtagctctcttgtagtacttgtctcttgaatcactaccttttatgatattatagcttaattatgactatatccatcagcgtgaaaactccagcaggagggaaggaaacagatgtccctgagtcattcagttccttcagaagttgtttttgagtacctactatgtgccaggctgtctgcttggcactgtggaatgagctcactccctgtgcccaagcagctcttggaataatttgcacacttctcaatacagctggtgcctagtagggttattcaattccattccatcacatcctgtgtgcctttaactcttactgtagagaggaaagggaaaggtgggggaaggacaggagaggagggaggcgatctgatacacggaagagagtttttactgtaatccggagaaaatgcaggtcttctttgatgcctttcatattggatgacataaatgagactgtttttaacactttattagcaatatgaagagtttcaaaagaggaaaaatgggtttttattgtaagtttacattatttgggctttataaaagcatggtcttttaaatgttcacacttccctgggcatgaatggactgtgctgtatggccctagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgc

SEQ ID NO: 160470 - DNA, 3011 bp, Homo sapiens
  Payload ID: 11371
  Gene Symbol: NFKB2
  Gene Name: nuclear factor of kappa light polypeptide gene enhancer in B-cells 2 (p49/p100)
  Uniprot ID: Q00653
  ENST ID: ENST00000189444
  CDS Start-End: 164-2863
actttcctgccccttccccggccaagcccaactccggatctcgctctccaccggatctcacccgccacacccggacaggcggctggaggaggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaactta

SEQ ID NO: 160471 - DNA, 3101 bp, Homo sapiens
  Payload ID: 11371
  Gene Symbol: NFKB2
  Gene Name: nuclear factor of kappa light polypeptide gene enhancer in B-cells 2 (p49/p100)
  Uniprot ID: Q00653
  ENST ID: ENST00000369966
  CDS Start-End: 251-2953
cacggtgagtggctggattcagacccctgggtggccgggacaagagaaaagagggaggagggcctttagcggacagcgcctggggctggagagcagcagctgcacacagccggaaagggcgcgcaggcgacgacactcggatccacgtcgacaccgttgtacaaagatacgcggacccgcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagcagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaactta

SEQ ID NO: 160472 - DNA, 3416 bp, Homo sapiens
  Payload ID: 11371
  Gene Symbol: NFKB2
  Gene Name: nuclear factor of kappa light polypeptide gene enhancer in B-cells 2 (p49/p100)
  Uniprot ID: Q00653
  ENST ID: ENST00000428099
  CDS Start-End: 564-3263
cttcctcttccgctaacttcccggcagcgcgccgctcagggtgggggccccgagggctggggccgtcggcttccccctggggatcccccgcttcagagaaagccaagcgttaggcgcagccaaagccgagaggcagcggaagctcccggcccggggtggcgctgggtcagcgggtaccttctcggcggtcccctggccggccgaactcgcgcctggtgtcctgtcaccccgctccccgccctgagtgagcctgtcccctctcaggggcgcgcccgagtcgctccgggttggctgcgccagtccagagttaaactttcagccaatgaaaaagggcgcgaggcgtgacgcacggaaacgtcatgggaattcccccctccggggggccgagaaggggctttcccggccctgagccctgctggcaggcgaggtgtcgcgaccggtcccaggtgggtcgggcgcggagagaagccgcaaccagagccgccgccacggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaacttatggca

SEQ ID NO: 160473 - DNA, 585 bp, Homo sapiens
  Payload ID: 11371
  Gene Symbol: NFKB2
  Gene Name: nuclear factor of kappa light polypeptide gene enhancer in B-cells 2 (p49/p100)
  ENST ID: ENST00000601386
  CDS Start-End: 519-585
cttcctcttccgctaacttcccggcagcgcgccgctcagggtgggggccccgagggctggggccgtcggcttccccctggggatcccccgcttcagagaaagccaagcgttaggcgcagccaaagccgagaggcagcggaagctcccggcccggggtggcgctgggtcagcgggtaccttctcggcggtcccctggccggccgaactcgcgcctggtgtcctgtcaccccgctccccgccctgagtgagcctgtcccctctcaggggcgcgcccgagtcgctccgggttggctgcgccagtccagagttaaactttcagccaatgaaaaagggcgcgaggcgtgacgcacggaaacgtcatgggaattcccccctccggggggccgagaaggggctttcccggccctgagccctgctggcaggcgaggtgtcgcgaccggtcccaggcgggcgtctaaaattctgggaagcagaacctggccggagccactagacagagccgggcctagcccagagacatggagagttgctacaacccaggtctggatggtattattgaatatgatgatttcaaattgaactcct

SEQ ID NO: 160474 - DNA, 472 bp, Homo sapiens
  Payload ID: 11371
  Gene Symbol: NFKB2
  Gene Name: nuclear factor of kappa light polypeptide gene enhancer in B-cells 2 (p49/p100)
  ENST ID: ENST00000471698
  CDS Start-End: 268-472
ctaagctgctctaactttcctgccccttccccggccaagcccaactccggatctcgctctccaccggatctcacccgccacacccggacaggcggctggaggaggtcggaccctcccccaaatctgggcccccatctcccgcccacccccatttagatctgaccccctcccccacgccactcctcccaactttaggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcct

SEQ ID NO: 160475 - DNA, 1628 bp, Homo sapiens
  Payload ID: 11371
  Gene Symbol: NFKB2
  Gene Name: nuclear factor of kappa light polypeptide gene enhancer in B-cells 2 (p49/p100)
  ENST ID: ENST00000610498
  CDS Start-End: 164-1411
actttcctgccccttccccggccaagcccaactccggatctcgctctccaccggatctcacccgccacacccggacaggcggctggaggaggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtgagggggtactgatggagggaggggtaaaggtaagagaagctgtggaggaaaaaaatctggggaggccgggcgtggtggctcacgcctgtaatccagcctttgggaggccaaggcaggcaattacctgagatcaggagttcaagaccagcttggccaacagcgtgaaacctcgtctctactaaaaatacaaacattagctgggcatggtggcaggcgcctgtaatcccagctactcgggaggctgaggcaggagaatcgcttgaaccctgggagacaagaggttgcagtaagctgagatcacaccactgcactccaggctgggcaataagagcgaaactccgtctc

SEQ ID NO: 160476 - DNA, 1558 bp, Homo sapiens
  Payload ID: 11372
  Gene Symbol: NFKBIA
  Gene Name: nuclear factor of kappa light polypeptide gene enhancer in B-cells inhibitor, alpha
  Uniprot ID: P25963
  ENST ID: ENST00000216797
  CDS Start-End: 103-1056
gcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatttattaaacagatttttacaaatg

SEQ ID NO: 160477 - DNA, 1537 bp, Homo sapiens
  Payload ID: 11372
  Gene Symbol: NFKBIA
  Gene Name: nuclear factor of kappa light polypeptide gene enhancer in B-cells inhibitor, alpha
  ENST ID: ENST00000557389
  CDS Start-End: 386-1069
cggggcggcagcggggacgcgaagtccccggttgcataaggcggggcgggagtttctggccgctggcgggcgccgagcagccgggaggggaagtacagggcgttccgagctggcgggagggcggggcggtctggccggcgcccgccggggccgcggggggaggggggcggaaagtccctgggcgcctgccaggaacactcagctcataataacctcgcggaaaacaccgcggcctcggcctccagaaaccccggccttgcgcaatcccccgcagcccgcgcctccctgggccccacgcggtgcactcaccacccctggggtttttccctctcttccccacaggttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtactttta

SEQ ID NO: 160478 - DNA, 1396 bp, Homo sapiens
  Payload ID: 11372
  Gene Symbol: NFKBIA
  Gene Name: nuclear factor of kappa light polypeptide gene enhancer in B-cells inhibitor, alpha
  ENST ID: ENST00000554001
  CDS Start-End: 73-321
gccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatgtatatt

SEQ ID NO: 160479 - DNA, 1400 bp, Homo sapiens
  Payload ID: 11372
  Gene Symbol: NFKBIA
  Gene Name: nuclear factor of kappa light polypeptide gene enhancer in B-cells inhibitor, alpha
  ENST ID: ENST00000557140
  CDS Start-End: 103-927
gcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatgagcgcaaaggggctgaaagaacatggacttgtatatttgtacaaaaaaaaagttttatttttctaaaaaaagaaaaaagaagaaaaaatttaaagggtgtacttatatccacactgcacactgcctggcccaaaacgtcttattgtggtaggatcagccctcattttgttgcttttgtgaactttttgtaggggacgagaaagatcattgaaattctgagaaaacttcttttaaacctcacctttgtggggtttttggagaaggttatcaaaaatttcatggaaggaccacattttatatttattgtgcttcgagtgactgaccccagtggtatcctgtgacatgtaacagccaggagtgttaagcgttcagtgatgtggggtgaaaagttactacctgtcaaggtttgtgttaccctcctgtaaatggtgtacataatgtattgttggtaattattttggtacttttatgatg

SEQ ID NO: 160480 - DNA, 212 bp, Homo sapiens
  Payload ID: 11372
  Gene Symbol: NFKBIA
  Gene Name: nuclear factor of kappa light polypeptide gene enhancer in B-cells inhibitor, alpha
  ENST ID: ENST00000553342
  CDS Start-End: 7-212
cgcgccatgttccaggcggccgagcgcccccaggagtgggccatggagggcccccgcgacgggctgaagaaggagcggctactggacgaccgccacgacagcggcctggactccatgaaagacgaggagtacgagcagatgctcaccgaggacggggactcgttcctgcacttggccatcatccatgaagaaaaggcactgaccatggaagt

SEQ ID NO: 160481 - DNA, 1159 bp, Homo sapiens
  Payload ID: 11373
  Gene Symbol: NFKBIB
  Gene Name: nuclear factor of kappa light polypeptide gene enhancer in B-cells inhibitor, beta
  Uniprot ID: Q15653
  ENST ID: ENST00000313582
  CDS Start-End: 35-1105
gcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctga

SEQ ID NO: 160482 - DNA, 991 bp, Homo sapiens
  Payload ID: 11373
  Gene Symbol: NFKBIB
  Gene Name: nuclear factor of kappa light polypeptide gene enhancer in B-cells inhibitor, beta
  ENST ID: ENST00000392079
  CDS Start-End: 120-932
cagacgcgctttcgtacaacacccagagcgccccagttagggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaacc

SEQ ID NO: 160483 - DNA, 2200 bp, Homo sapiens
  Payload ID: 11373
  Gene Symbol: NFKBIB
  Gene Name: nuclear factor of kappa light polypeptide gene enhancer in B-cells inhibitor, beta
  ENST ID: ENST00000509705
  CDS Start-End: 54-251
aaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacgcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgtgagtcaggaggagagacagggcagcccagctggggggtcaggatagaccggcaggcaagaagcccaagaagataattaggcaccgaccttgggctgctgttagagaactcaggcagcagcgccagtgacacggggcactagtcaggagagacctggacaggggtggtgggaagagcttgggcagaagtggctgaaaaactaaggcagtggcaaaggtagaactcaggcaggggtggagaaaaggcgttggtcgcagtgattggtgaacacagcgggggtgggtggtagcgctgggggtgattttaggcagcaagaattggagaactcacactgcgaaaagaaaaccttgggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccagctcagttgccgaaactctggagtggcggctggctagaaattggtctgtagaaatgaccttgaaaatggagttctggccaggtgcggtggctcacgcctgtaatcccagcactttgggaggccgaggcaggcagatcacgaggtcaggagttcgagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatcttaaaaaaaaaaaaaaaaaaaagaaagaaaagaaaatggagttctgagagctaggaaactgggaggttgagccaggagcaggggaacttgggctttgaggcgagacctaattcttagggtgctctatgaggacatgggtggtgggcaaagtgacagccgcctgagcccctctgcctggtcccctttgcccccaggatgaatacgacgacattgtggttcacagcagccgcagccaaacccggctgcctcccaccccagcctcaaaacctcttcctgacgacccccgccccgtgtgatttgtttcattgttaatataatttccagtttaataaacaaaaccctagttctgacaaccag

SEQ ID NO: 160484 - DNA, 543 bp, Homo sapiens
  Payload ID: 11373
  Gene Symbol: NFKBIB
  Gene Name: nuclear factor of kappa light polypeptide gene enhancer in B-cells inhibitor, beta
  ENST ID: ENST00000575359
  CDS Start-End: 96-543
gcaaagcccagctacaggcgggcgactgcggggggcccctgaggcggcgggggccatggctggggtcgcgtgcttgggaaaagctgccgacgcagatgaatggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgc

SEQ ID NO: 160485 - DNA, 1929 bp, Homo sapiens
  Payload ID: 11373
  Gene Symbol: NFKBIB
  Gene Name: nuclear factor of kappa light polypeptide gene enhancer in B-cells inhibitor, beta
  Uniprot ID: Q15653
  ENST ID: ENST00000572515
  CDS Start-End: 82-1098
gcagggcggaagctccagaactcccggcaaagcccagctacaggcgggcgactgcggggggcccctgaggcggcgggggccatggctggggtcgcgtgcttgggaaaagctgccgacgcagatgaatggtgcgacagcggcctgggctccctgggtccggacgcagcggcccccggaggacctgggttgggcgcggagttgggcccggggctgtcgtgggctcccctcgtcttcggctacgtcactgaggatggggacacggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcggagacgagggcgtgagtcaggaggagagacagggcagcccagctggggggtcaggatagaccggcaggcaagaagcccaagaagataattaggcaccgaccttgggctgctgttagagaactcaggcagcagcgccagtgacacggggcactagtcaggagagacctggacaggggtggtgggaagagcttgggcagaagtggctgaaaaactaaggcagtggcaaaggtagaactcaggcaggggtggagaaaaggcgttggtcgcagtgattggtgaacacagcgggggtgggtggtagcgctgggggtgattttaggcagcaagaattggagaactcacactgcgaaaagaaaaccttgggtggcagtgatttgaacaccggcagtgctggggcaggacccgagccagcggtggggagagatatagtcagagaacccagcaatacagatccgtccttgggcaaggcgcggtgctggatgatgggtgcggaggaatttgggtaaaggcagagggaaggggtggaggagggccagctcagttgccgaaactctggagtggcggctggctagaaattggtctgtagaaatgaccttgaaaatggagttctggccaggtgcggtggctcacgcctgtaatcccagcactttgggaggccgaggcaggcagatcacgaggtcaggagttcgagaccagcctggccaacatggcaagaccctgtctctactaaaaatacaaaaattagctgggcgtggtggcgcatgcctataatcccagctacttgggaggctgaggtaggagaattgcttgaacctgggaggtggaggttgcagtgaacctagatcacgccactgcattccagcctgggcaacagagcgagactccatctt

SEQ ID NO: 160486 - DNA, 820 bp, Homo sapiens
  Payload ID: 11373
  Gene Symbol: NFKBIB
  Gene Name: nuclear factor of kappa light polypeptide gene enhancer in B-cells inhibitor, beta
  ENST ID: ENST00000576510
  CDS Start-End: 120-820
cagacgcgctttcgtacaacacccagagcgccccagttagggcactgcacttggctgtgattcatcagcatgaacccttcctggattttcttctaggcttctcggccggcactgagtacatggacctgcagaatgacctaggccagacagccctgcacctggcagccatcctgggggagacatccacggtggagaagctgtacgcagcaggcgccgggctgtgtgtggcggagcgtaggggccacacggcgctgcacctggcctgccgtgtgggggcacacgcctgtgcccgtgccctgcttcagccccgcccccggcgccccagggaagcccccgacacctacctcgctcagggccctgaccgtactcccgacaccaaccatacccctgtcgccttgtaccccgattccgacttggagaaggaagaagaggagagtgaggaggactggaagctgcagctggaggctgaaaactacgagggccacaccccactccacgtggccgttatccacaaagatgtggagatggtccggctgctccgagatgctggagctgaccttgacaaaccggagcccacgtgcggccggagcccccttcatttggcagtggaggcccaggcagccgatgtgctggagcttctcctgagggcaggcgcgaaccctgctgcccgcatgtacggtggccgcaccccactcggcagtgccatgctccggcccaaccccatcctcgcccgcctcctccgtgcacacggagcccctgagcccgagggcgaggacgagaaatccggcccctgcagcagcagtagcgacagcgacagcgg

SEQ ID NO: 160487 - DNA, 543 bp, Homo sapiens; identical to SEQ ID NO: 160484
  Payload ID: 11373
  Gene Symbol: NFKBIB
  Gene Name: Nuclear factor of kappa light polypeptide gene enhancer in B-cells inhibitor, beta
  ENST ID: ENST00000635399
  CDS Start-End: 96-543

SEQ ID NO: 160488 - DNA, 2200 bp, Homo sapiens; identical to SEQ ID NO: 160483
  Payload ID: 11373
  Gene Symbol: NFKBIB
  Gene Name: Nuclear factor of kappa light polypeptide gene enhancer in B-cells inhibitor, beta
  ENST ID: ENST00000635416
  CDS Start-End: 54-251

SEQ ID NO: 160489 - DNA, 1159 bp, Homo sapiens; identical to SEQ ID NO: 160481
  Payload ID: 11373
  Gene Symbol: NFKBIB
  Gene Name: Nuclear factor of kappa light polypeptide gene enhancer in B-cells inhibitor, beta
  ENST ID: ENST00000635517
  CDS Start-End: 35-1105

SEQ ID NO: 160490 - DNA, 1929 bp, Homo sapiens; identical to SEQ ID NO: 160485
  Payload ID: 11373
  Gene Symbol: NFKBIB
  Gene Name: Nuclear factor of kappa light polypeptide gene enhancer in B-cells inhibitor, beta
  ENST ID: ENST00000634647
  CDS Start-End: 82-1098

SEQ ID NO: 160491 - DNA, 991 bp, Homo sapiens; identical to SEQ ID NO: 160482
  Payload ID: 11373
  Gene Symbol: NFKBIB
  Gene Name: Nuclear factor of kappa light polypeptide gene enhancer in B-cells inhibitor, beta
  ENST ID: ENST00000634995
  CDS Start-End: 120-932

SEQ ID NO: 160492 - DNA, 820 bp, Homo sapiens; identical to SEQ ID NO: 160486
  Payload ID: 11373
  Gene Symbol: NFKBIB
  Gene Name: Nuclear factor of kappa light polypeptide gene enhancer in B-cells inhibitor, beta
  ENST ID: ENST00000635236
  CDS Start-End: 120-820

SEQ ID NO: 160493 - DNA, 1834 bp, Homo sapiens
  Payload ID: 11374
  Gene Symbol: NFKBID
  Gene Name: nuclear factor of kappa light polypeptide gene enhancer in B-cells inhibitor, delta
  Uniprot ID: Q8NI38
  ENST ID: ENST00000396901
  CDS Start-End: 575-1516
ttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagct

SEQ ID NO: 160494 - DNA, 1036 bp, Homo sapiens
  Payload ID: 11374
  Gene Symbol: NFKBID
  Gene Name: nuclear factor of kappa light polypeptide gene enhancer in B-cells inhibitor, delta
  ENST ID: ENST00000585925
  CDS Start-End: 587-1036
tcagggactgcgttcgccggagcgcgacccggggactcccaggcctgtgggcgggccctgcccaggactgggcggtgccataacccctagtttaaaaactcgcgggtaccggacccaagatcggggacccggcggcggctccgcgggggaaacagcgaggctggcgcagcgccgaggccgcggccctgggggcccgcaatccacgccacggaatccccgagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggaccccccagacacccagttctatgtaggatcttctctgccacaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttg

SEQ ID NO: 160495 - DNA, 1552 bp, Homo sapiens
  Payload ID: 11374
  Gene Symbol: NFKBID
  Gene Name: nuclear factor of kappa light polypeptide gene enhancer in B-cells inhibitor, delta
  ENST ID: ENST00000590828
  CDS Start-End: 1-197
actctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccagagatgaggtcttgctgtgttgtccaggctggtctgcagctcctggcctcaagtgatcctccttcttcagcttcccaaagtgctaggattacaggcgtgaaccaccgcactccgccaagggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagctcttcgttcccagaaacccagatgtaatccccctacgtggtgcttggggcatcccgataccatctcagtaaatctcctacaatggcctcctcaccctccccgggacccacacccttcaggtcctcaccctgagacaggagggaccctctgagatcagggacccttaggtctcactgctctctgattcagagctcagctgggcccccagttccagaccccagcattcccggtcactccctccctaatctgagcatcactcaagctctttattaaactcaatttgggccagatttggtggctcatgcctgtaatcctaacactctgggaggccgaggcgggcggatcacttgaggtgaggagtttgagaccagcctggccaacatggtgaaaccctgtctccactaaaaatacaaaaacaattggctggacatggtggcatgcgcctgtagtcccagctacttgggaggctgaggcagaagaattgattgaacccaggaggcggaggttgcagtgagccgagattgtgccactgcactccagcctaggtgacaaagagagactctgtctcaaaaaaaaaaaaaaaaaaaaa

SEQ ID NO: 160496 - DNA, 1736 bp, Homo sapiens
  Payload ID: 11374
  Gene Symbol: NFKBID
  Gene Name: nuclear factor of kappa light polypeptide gene enhancer in B-cells inhibitor, delta
  Uniprot ID: Q8NI38
  ENST ID: ENST00000606253
  CDS Start-End: 477-1418
aaaatttgctgattaaatgaatgtgggtgtgtttgagagggatcctagacagccaagccttctggcatgaaacgctgagaagatgggagtgtctgctggcagagatgaaagtgagcaggggtgagcgcagccactgcccaacgcaaaccgtgaagaagcttctggaagagcagaggcgccgccagcagcagcagcccgacgctggcggggtgcagggacaatttctccctcccccagagcagcccctgaccccatctgtgaatgaggctgtgactggccaccctcccttcccagcacactcggagactgtgggttctggacctagcagcctgggctttccagactgggaccccaacacgcatgctgcctacactgacagcccctactcttgccctgcttctgctgccgaaaatttcctgcctcctgacttctacccaccctcggacccagggcagccgtgcccatttccccagggcatggaggctggaccctggagagtttctgcacccccttcaggacccccacagttccccgctgtggtccctggaccatcgctggaggtggcccgagctcacatgctggctttggggccacagcagctgctggcccaggatgaggagggggacacgctccttcacctgtttgcggctcgggggctgcgctgggcggcatatgctgcggctgaggtgctccaggtgtaccggcgtcttgacattcgtgagcataagggcaagacccctctcctggtggcggctgctgccaaccagcccctgattgtggaggatctgttgaacctgggagcagagcccaatgccgctgaccatcagggacgttcggtcttgcacgtggccgctacctacgggctcccaggagttctcttggctgtgcttaactctggggtccaggttgacctggaagccagagacttcgagggcctcaccccgctccacacggccatcctggcccttaacgttgctatgcgcccttccgacctctgtccccgggtgctgagcacacaggcccgagacaggctggattgtgtccacatgttgctgcaaatgggtgctaatcacaccagccaggagatcaagagcaacaagacagttctgcacttggccgtgcaggctgccaaccccactctggttcagctgctgctggagctgccccggggagacctgcggacctttgtcaacatgaaggcccacgggaacacagccctccacatggcggctgccctgccccctgggccggcccaggaggccatcgtgcggcacctgttggcagctggggcggaccccacactgcgcaacctggagaatgagcagcccgttcacctgctgcggcccgggccgggccctgaggggctccggcagctgttgaagaggagccgtgtggcgccgccaggcctgtcctcttaggactcaaacccagaccctggactgattttccagtccccaccgtcctgcgggacagccagcgtatgctaatgttgcaaacccatgataatgtatgtggaatatcctgccattggggttttacattaaaaccccagaatggctgcagaggggtgaacaggccccaatatttggggtgctgtgatacccctcttctacccacaaggagccctcttgatgatttctgtgaaatcgaggccccttgattgtttctgtgaaacaccctgcacccctagtcctttccccactgagatctttcgggttctctcccctaactcagct

SEQ ID NO: 160497 - DNA, 2581 bp, Homo sapiens
  Payload ID: 11375
  Gene Symbol: NFKBIE
  Gene Name: nuclear factor of kappa light polypeptide gene enhancer in B-cells inhibitor, epsilon
  Uniprot ID: O00221
  ENST ID: ENST00000275015
  CDS Start-End: 26-1528
aatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggacccgcttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaagtttttcccttctagagctgttttgcgcgcatgcatgtctgtgtgcattggggctttttagacaggcctgccctgtgactttgtggtagaggcagagagaaggaaattgtcccctgagcacggtagggccttgctgggtggggtcagaggccagtagttccaggcctttctctgtgtccagcacagacccttgtccttgctgtggaaatgatgagggatggagggacaagaggaagaatgagaggacacacgccctggagccctcaccactgccctgggggttgccatctggaggagcctggggataagggtaacccagggaggctgggcacgagggagctgactccacgtttttccccccgttcctcaccttcgagggccctgctaggtcacccctatgctggcatgaagagcatggggcaataaaccagcacagtctctgaccacttggagcgtctcatccagtgagagagacagccgttaaaagcataaacatccaaataaagatgcctttccaagtt

SEQ ID NO: 160498 - DNA, 561 bp, Homo sapiens
  Payload ID: 11375
  Gene Symbol: NFKBIE
  Gene Name: nuclear factor of kappa light polypeptide gene enhancer in B-cells inhibitor, epsilon
  ENST ID: ENST00000443607
  CDS Start-End: 1-168
ggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgtta

SEQ ID NO: 160499 - DNA, 901 bp, Homo sapiens
  Payload ID: 11375
  Gene Symbol: NFKBIE
  Gene Name: nuclear factor of kappa light polypeptide gene enhancer in B-cells inhibitor, epsilon
  ENST ID: ENST00000477930
  CDS Start-End: 248-673
ggggcgaggaggaggacccgcttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcgga

SEQ ID NO: 160500 - DNA, 2050 bp, Homo sapiens
  Payload ID: 11375
  Gene Symbol: NFKBIE
  Gene Name: nuclear factor of kappa light polypeptide gene enhancer in B-cells inhibitor, epsilon
  ENST ID: ENST00000616555
  CDS Start-End: 26-1525
aatgaatgaatgaatgaatgagtgaatgaatcaacgaaggagtgagtcaaggcccgggaaccacagactccaagcctacgcagagcccgggaagggggattccggaggggcggggcctctttccggaagcgcccgccgggggcggggagggggcggggccatccgcgtgaggcgaccctgttggtccggaggggcggggcgaggaggaggacccgcttgggcggttcggctgcccacagtaaccgctgggtggacctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagacttggcctgtgcccgctgcctgctggaagggcggccagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgtt

SEQ ID NO: 160501 - DNA, 2327 bp, Homo sapiens
  Payload ID: 11375
  Gene Symbol: NFKBIE
  Gene Name: nuclear factor of kappa light polypeptide gene enhancer in B-cells inhibitor, epsilon
  ENST ID: ENST00000619360
  CDS Start-End: 189-1274
cctggccagcgctccgaaccttgtcctcgctgcgcgccggcccctcggagccccacagcccgggaaggaggccgccgcgggccgggcgcccgctctgccaagcggacccgcaacccggaaaggcggcgcggcggagcctggagccggatcctgctcagaccgggccccggccggccagagccgcgggcatgtcggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactcccccacgtgggggcgctgagccctcagcagctggaagcactcacttacatctccgaggacggagacacgctggtccacctggcagtgattcatgaggccccagcggtgctgctctgttgcctggctttgctgccccaggaggtcctggacattcaaaataacctttaccagacagcactccatctggctgtacatctggaccaaccgggcgcagttcgggcactggtgctgaagggggccagccgggcactacaggaccggcatggtgacacagcccttcatgtggcctgccagcgccagcacttggcctgtgcccgctgcctgctggaagggcggccagagccaggcagaggaacatctcactctctggacctccagctgcaaaactggcaaggtctggcttgtctccacattgccacccttcagaagaaccaaccactcatggaattgctgcttcggaatggagctgacattgatgtgcaggagggcaccagtggtaagacagcgctgcacctggctgtggaaacccaagagcggggcctggtacagttcctgctccaggctggtgcccaggtagatgcccgcatgctgaacgggtgcacacccctgcacctggcagctggccggggtctcatgggcatctcatccactctgtgcaaggcgggtgctgactccctgctgcggaatgtggaggatgagacgccccaggacctgactgaggaatcccttgtccttttgccctttgatgacctgaagatctcagggaaactgctgctgtgtaccgactgaagccaggcagggtctgggatcctcagggctccacctctccatctggaagccggagccataactgctgcagtttgggcccaggctatgtgctcttctggtgccctagggactgctgtggccagagcctggggccagccagtacagtcctgagccgaggaggagggactgcaagtggaagagagccagtctggaaggaagagctttccaggtggacagggcttcttggaagacccccaaagccccaggtatcctgggtgaagcctgtttgcctctcttgaaaatggcaggtgctcttgttttacccatgttgggtcagcctgaaactgccaaccagtaggaagcatggactctcctgagtgagaagagactgaaataggagcaagcagaaccctgagaggtgtcccatcttattgctgttgaggaccctgaaacaccgttgtttaaagacttcacacagaaggctctgaactgagccactggggaagggaagtttcagtaacatgacactaaaatggcagagacgttaaaaaaagtttttcccttctagagctgttttgcgcgcatgcatgtctgtgtgcattggggctttttagacaggcctgccctgtgactttgtggtagaggcagagagaaggaaattgtcccctgagcacggtagggccttgctgggtggggtcagaggccagtagttccaggcctttctctgtgtccagcacagacccttgtccttgctgtggaaatgatgagggatggagggacaagaggaagaatgagaggacacacgccctggagccctcaccactgccctgggggttgccatctggaggagcctggggataagggtaacccagggaggctgggcacgagggagctgactccacgtttttccccccgttcctcaccttcgagggccctgctaggtcacccctatgctggcatgaagagcatggggcaataaaccagcacagtctctgaccacttggagcgtctcatccagtgagagagacagccgttaaaagcataaacatccaaataaagatgcctttccaagtt

SEQ ID NO: 160502 - DNA, 2058 bp, Homo sapiens
  Payload ID: 11376
  Gene Symbol: NFKBIZ
  Gene Name: nuclear factor of kappa light polypeptide gene enhancer in B-cells inhibitor, zeta
  Uniprot ID: Q9BYH8
  ENST ID: ENST00000326151
  CDS Start-End: 116-1906
gtactggcccgcgccgtccgcccgccgacagctccctgagccagcccgggaggcagccgcgcgcagcgagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaaacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatatt

SEQ ID NO: 160503 - DNA, 3923 bp, Homo sapiens
  Payload ID: 11376
  Gene Symbol: NFKBIZ
  Gene Name: nuclear factor of kappa light polypeptide gene enhancer in B-cells inhibitor, zeta
  Uniprot ID: Q9BYH8
  ENST ID: ENST00000326172
  CDS Start-End: 116-2272
gtactggcccgcgccgtccgcccgccgacagctccctgagccagcccgggaggcagccgcgcgcagcgagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactggaactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaata

SEQ ID NO: 160504 - DNA, 3787 bp, Homo sapiens
  Payload ID: 11376
  Gene Symbol: NFKBIZ
  Gene Name: nuclear factor of kappa light polypeptide gene enhancer in B-cells inhibitor, zeta
  Uniprot ID: Q9BYH8
  ENST ID: ENST00000394054
  CDS Start-End: 280-2136
ctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggttaacaggaagatctcgagggccctggctgaacttcaccttttggctttcttggcctgatgctgaactctcgaggttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaagaaaagaagaaaaatatctaatttctcttggcagatttgcatatttcatacccaggtatctgggatctagacatctgaatttgatctcaatggtaacattgccttcaattaacagtagcttttgagtaggaaaggactttgatttgtggcacaaaacattattaatatagctattgacagtttcaaagcaggtaaattgtaaatgtttctttaagaaaaagcatgtgaaaggaaaaaggtaaatacagcattgaggcttcatttggccttagtccctgggagttactggcgttggacaggcttcagtcattggactagatgaaaggtgtccatggttagaatttgatctttgcaaactgtatataattgttatttttgtccttaaaaatattgtacatacttggttgttaacatggtcatatttgaaatgtataagtccataaaatagaaaagaacaagtgaattgttgctatttaaaaaaattttacaattcttactaaggagtttttattgtgtaatcactaagtctttgtagataaagcagatggggagttacggagttgttcctttactggctgaaagatatattcgaattgtaaagatgctttttctcatgcattgaaattatacattatttgtagggaattgcatgcttttttttttttttctcccgagacagggtcttgctctggcgcccaggctggagtacagtggcatgatcttggctcacttcagccttgacttgggctcaagtgatcctcctacctgagccttctgagtaactggaactacaggtgtgcactcctcgcctggctaattttttattttttgtacaggcaggatcttgccaccttgcccaggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaata

SEQ ID NO: 160505 - DNA, 564 bp, Homo sapiens
  Payload ID: 11376
  Gene Symbol: NFKBIZ
  Gene Name: nuclear factor of kappa light polypeptide gene enhancer in B-cells inhibitor, zeta
  ENST ID: ENST00000491281
  CDS Start-End: 176-564
gatgtaggtgtaattttcttcttgtgaatattttagtggaaagctgtagcagaggataagggtttgggaatagcgttaaaggtcatgacttatttctcagtttttatggaatttttcagtaaaaagacttgaccgtcaaagaaaaggaaactgctgttatcaagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgt

SEQ ID NO: 160506 - DNA, 1338 bp, Homo sapiens
  Payload ID: 11376
  Gene Symbol: NFKBIZ
  Gene Name: nuclear factor of kappa light polypeptide gene enhancer in B-cells inhibitor, zeta
  ENST ID: ENST00000461724
  CDS Start-End: 1008-1338
tcctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaaggttaacaggaagatctcgagggccctggctgaacttcaccttttggctttcttggcctgatgctgaactctcgaggttcgggatgttgcctaaaaccgtcgacaaacgctatgtttgagaagggaggctacgctggggcgccggaggagacaggcccttaagaaccttccagagatgccttaactgggctaacagctcgccgcgccggggcaggcagaggggtgcggggcgcgctccttccaggacttgccagtccccaagaaccaggccaaccggttccctccactgactcccgcctccctctgcaggcccagccctgcgccgcgcgccctctccccgggcgcccaggcccggcgggggcctagagggcagggatggcccgggcgagggacggggtcccggaggcgggaggcgggaggcgggaggcgggaagcgggaggctggaagccgcgcgctgtcggggtttcccggtgaagggcaggcaaacaaccggtcggtctgggcggagccgggcgggcggggcgagggcggagggcggagggcgcattgcctcatcctgtacattttactggaaatcggacgcatccggaggaggggctgggaggcggcccgggcaccgccaatggccgggccgggcgccggggaggtcggcgagcgctgcggcccgttaaataccctggcagtcccgcgccgcgcccgtactggcccgcgccgtccgcccgccgacagctccctgagccagcccgggaggcagccgcgcgcagcgagccggtggcgcaggtgtcggggtcctcgagcgcccagcctgggagcatgattgtggacaagctgctggacgacagccgcggcggagaggggctgcgggacgcggcgggcggctgcggcctcatgaccagcccgctcaacctgagctacttctacggcgcgtcgccgcccgccgccgccccgggcgcctgcgacgccagctgctcggtcttgggcccctcggcgcccggctcgcccggctccgactcctccgacttctcctctgcctcgtcggtgtcctcctgcggcgccgtggagtcccggtcgagaggcggcgcccgcgccgagcgccagccagttgagccccatatgggggttggcaggcagcagagaggcccct

SEQ ID NO: 160507 - DNA, 2006 bp, Homo sapiens
  Payload ID: 11376
  Gene Symbol: NFKBIZ
  Gene Name: nuclear factor of kappa light polypeptide gene enhancer in B-cells inhibitor, zeta
  ENST ID: ENST00000483180
  CDS Start-End: 204-2006
ctcttgccacgaggtcagacggcgagttcttagagaaaaaggctgcttagctgctgcttatcatgtaacctcaaaaggaaactgatcgtctttctcatgctgtcacgtacttgggttattatcgctgattacagctggaaacaattgatttgctcttacgtatttgtgtgacttgactcttcaaacacaaagttgagccccatatgggggttggcaggcagcagagaggcccctttcaaggtgttcgggtaaagaactcagtgaaggaactcctgttgcacatccgaagtcataaacagaaggcttctggccaagctgtggatgattttaagacacaaggtgtgaacatagaacagttcagagaattgaagaacacagtatcatacagtgggaaaaggaaagggcccgattcgttgtctgatggacctgcttgcaaaaggccagctctgttgcattcccaatttttgacaccacctcaaacaccaacgcccggggagagcatggaagatgttcatctcaatgaacccaaacaggagagcagtgctgatctgcttcagaacattatcaacattaagaatgaatgcagccccgtttccctgaacacagttcaagttagctggctgaaccccgtggtggtccctcagagctcccccgcagagcagtgtcaggacttccatggagggcaggtcttttctccacctcagaaatgccaaccattccaagtcaggggctcccaacaaatgatagaccaggcttccctgtaccagtattctccacagaaccagcatgtagagcagcagccacactacacccacaaaccaactctggaatacagtccttttcccatacctccccagtcccccgcttatgaaccaaacctctttgatggtccagaatcacagttttgcccaaaccaaagcttagtttcccttcttggtgatcaaagggaatctgagaatattgctaatcccatgcagacttcctccagtgttcagcagcaaaatgatgctcacttgcacagcttcagcatgatgcccagcagcgcctgtgaggccatggtggggcacgagatggcctctgactcttcaaacacttcactgccattctcaaacatgggaaatccaatgaacaccacacagttagggaaatcactttttcagtggcaggtggagcaggaagaaagcaaattggcaaatatttcccaagaccagtttctttcaaaggatgcagatggtgacacgttccttcatattgctgttgcccaagggagaagggcactttcctatgttcttgcaagaaagatgaatgcacttcacatgctggatattaaagagcacaatggacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggcgattcagaagggagcagtgggaagtaatcagtttgtggatcttgaggcaactaactatgatggcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggatcgcaaaagtggccgcacagccctgcatttggcagctgaagaagcaaatctggaactcattcgcctctttttggagctgcccagttgcctgtcttttgtgaatgcaaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacag

SEQ ID NO: 160508 - DNA, 548 bp, Homo sapiens
  Payload ID: 11376
  Gene Symbol: NFKBIZ
  Gene Name: nuclear factor of kappa light polypeptide gene enhancer in B-cells inhibitor, zeta
  ENST ID: ENST00000477601
  CDS Start-End: 1-392
gcctgactccccttcactgtgcagtcatagcccacaatgctgtggtccatgaactccagagaaatcaacagcctcattcacctgaagttcaggagcttttactgaagaataagagtctggttgataccattaagtgcctaattcaaatgggagcagcggtggaagcgaaggcttacaatggcaacactgccctccatgttgctgccagcttgcagtatcggttgacacaattagatgctgtccgcctgttgatgaggaagggagcagacccaagtactcggaacttggagaacgaacagccagtgcatttggttcccgatggccctgtgggagaacagatccgacgtatcctgaagggaaagtccattcagcagagagctccaccgtattagctccattagcttggagcctggctagcaacactcactgtcagttaggcagtcctgatgtatctgtacatagaccatttgccttatattggcaaatgtaagttgtttctatgaaacaaacatatttagttcactattatatagtgggttatattaaaa

SEQ ID NO: 160509 - DNA, 1401 bp, Homo sapiens
  Payload ID: 11377
  Gene Symbol: NFKBIL1
  Gene Name: nuclear factor of kappa light polypeptide gene enhancer in B-cells inhibitor-like 1
  ENST ID: ENST00000376145
  CDS Start-End: 83-1183
ccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 160510 - DNA, 1411 bp, Homo sapiens
  Payload ID: 11377
  Gene Symbol: NFKBIL1
  Gene Name: nuclear factor of kappa light polypeptide gene enhancer in B-cells inhibitor-like 1
  ENST ID: ENST00000376146
  CDS Start-End: 117-1193
agggatgaggcaggggcggagacgggggagtactgaggtgagagaaggagaacttgattggtggtaacagaggaagcataaagggttgtgaatgcggtgaaaagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 160511 - DNA, 1478 bp, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000376148
  CDS Start-End: 115-1260
atttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcccgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 160512 - DNA, 1401 bp, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000383500
  CDS Start-End: 83-1183
ccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 160513 - DNA, 1411 bp, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000400279
  CDS Start-End: 117-1193
agggatgaggcaggggcggagacgggggagtactgaggtgagagaaggagaacttgattggtggtaacagaggaagcataaagggttgtgaatgcggtgaaaagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 160514 - DNA, 1478 bp, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000400285
  CDS Start-End: 115-1260
atttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 160515 - DNA, 1478 bp, Homo sapiens; identical to SEQ ID NO: 160514
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000419122
  CDS Start-End: 115-1260

SEQ ID NO: 160516 - DNA, 1478 bp, Homo sapiens; identical to SEQ ID NO: 160514
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000424652
  CDS Start-End: 115-1260

SEQ ID NO: 160517 - DNA, 1411 bp, Homo sapiens; identical to SEQ ID NO: 160513
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000453377
  CDS Start-End: 117-1193

SEQ ID NO: 160518 - DNA, 1478 bp, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000442947
  CDS Start-End: 115-1260
atttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctctgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 160519 - DNA, 1401 bp, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000421396
  CDS Start-End: 83-1183
ccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctctgccatgggaataaagaataaggatggggagacccctggccaaattttgggctggggacccccctgggattctgctgaagaggaggaagaagatgatgcctccaaggagcgggaatggagacagaagctccagggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 160520 - DNA, 1411 bp, Homo sapiens; identical to SEQ ID NO: 160513
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000456607
  CDS Start-End: 117-1193

SEQ ID NO: 160521 - DNA, 1401 bp, Homo sapiens; identical to SEQ ID NO: 160512
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000430501
  CDS Start-End: 83-1183

SEQ ID NO: 160522 - DNA, 1411 bp, Homo sapiens; identical to SEQ ID NO: 160513
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000428467
  CDS Start-End: 117-1193

SEQ ID NO: 160523 - DNA, 1478 bp, Homo sapiens; identical to SEQ ID NO: 160514
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000455376
  CDS Start-End: 115-1260

SEQ ID NO: 160524 - DNA, 1411 bp, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000430961
  CDS Start-End: 117-1193
agggatgaggcaggggcggagacgggggagtactgaggtgagagaaggagaacttgattggtggtaacagaggaagcataaagggttgtgaatgcggtgaaaagcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctctgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctca

SEQ ID NO: 160525 - DNA, 1478 bp, Homo sapiens; identical to SEQ ID NO: 160514
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000432160
  CDS Start-End: 115-1260

SEQ ID NO: 160526 - DNA, 1401 bp, Homo sapiens; identical to SEQ ID NO: 160512
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000451911
  CDS Start-End: 83-1183

SEQ ID NO: 160527 - DNA, 1411 bp, Homo sapiens; identical to SEQ ID NO: 160513
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000434332
  CDS Start-End: 117-1193

SEQ ID NO: 160528 - DNA, 1401 bp, Homo sapiens; identical to SEQ ID NO: 160512
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000414391
  CDS Start-End: 83-1183

SEQ ID NO: 160529 - DNA, 1401 bp, Homo sapiens; identical to SEQ ID NO: 160512
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENST ID: ENST00000419623
  CDS Start-End: 83-1183

SEQ ID NO: 160530 - DNA, 700 bp, Homo sapiens
  Payload ID: 11377
  Gene Symbol: NFKBIL1
  Gene Name: nuclear factor of kappa light polypeptide gene enhancer in B-cells inhibitor-like 1
  ENST ID: ENST00000468464
  CDS Start-End: 35-700
tctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgagaagtccactgctatccacagctgcccttccccactggctgctttccatctgcatgaatgcgtcacactaggctcctctgccccctcctctgtgcttccctgcttc

SEQ ID NO: 160531 - DNA, 554 bp, Homo sapiens
  Payload ID: 11377
  Gene Symbol: NFKBIL1
  Gene Name: nuclear factor of kappa light polypeptide gene enhancer in B-cells inhibitor-like 1
  ENST ID: ENST00000460131
  CDS Start-End: 56-433
cacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtcagcagtcatttggaaagagcttgctctgccgccggccatagttgttgccggttcacctccccacccctctcccatcatcccctgcctacaccgatttcttcctcccgctgctaagccgctgtccctccgccatgggaataaagaataaggatggggagaccc

SEQ ID NO: 160532 - DNA, 554 bp, Homo sapiens; identical to SEQ ID NO: 160531
  Payload ID: 11377
  Gene Symbol: NFKBIL1
  Gene Name: nuclear factor of kappa light polypeptide gene enhancer in B-cells inhibitor-like 1
  ENST ID: ENST00000496233
  CDS Start-End: 56-433

SEQ ID NO: 160533 - DNA, 5093 bp, Homo sapiens
  Payload ID: 11378
  Gene Symbol: NFRKB
  Gene Name: nuclear factor related to kappaB binding protein
  Uniprot ID: Q6P4R8
  ENST ID: ENST00000446488
  CDS Start-End: 105-4004
caggattccagaattggaaataacgggagggaggacctggtccagcttcccttcctcaaataaggaaattgacacctggcgtgagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggatctcagctcatggcttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagcccagaccaatttgtgtttgtattatctgtggctgctttcagattcgaaggcagaattgagtagttgacatagagactggatggccctgaagcctaaagtatttcctatatggccttttaagtaaaagcgttttttgtttgtt

SEQ ID NO: 160534 - DNA, 568 bp, Homo sapiens
  Payload ID: 11378
  Gene Symbol: NFRKB
  Gene Name: nuclear factor related to kappaB binding protein
  ENST ID: ENST00000526884
  CDS Start-End: 293-568
gcgtctgggagcccgcggccggagaagggctgcgggttagggggccggcgcccgcggttcaggattccagaattggaaataacgggagggaggacctggtccagcttcccttcctcaaataaggaaattgacacctggcgtgagaaggggttttgccatgttcgctaggctggtctcaaactcatggattcaaggggactgcccgcctggacctcccaaagtactgagattgagttactgtaggagcattctgagaaaagagctcttccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttg

SEQ ID NO: 160535 - DNA, 938 bp, Homo sapiens
  Payload ID: 11378
  Gene Symbol: NFRKB
  Gene Name: nuclear factor related to kappaB binding protein
  ENST ID: ENST00000532225
  CDS Start-End: 375-938
gcacccagactccttgcgggagcgagtgcgtctgggagcccgcggccggagaagggctgcgggttagggggccggcgcccgcggttcaggattccagaattggaaataacgggagggaggacctggtccagcttcccttcctcaaataaggaaattgacacctggcgtgagaaggggttttgccatgttcgctaggctggtctcaaactcatggattcaaggggactgcccgcctggacctcccaaagtactgagattgtagtctcattttactcatctgtaaaatgaaggcatatgaaatttatgaatttaggagttactgtaggagcattctgagaaaagagctcttccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacc

SEQ ID NO: 160536 - DNA, 539 bp, Homo sapiens
  Payload ID: 11378
  Gene Symbol: NFRKB
  Gene Name: nuclear factor related to kappaB binding protein
  ENST ID: ENST00000526940
  CDS Start-End: 28-396
gtccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagatactgaggcagcaaagagcggttttgtgtaacactttgctgtctaggctgtgttctaaaaaacaaaaatgtattgacttatatagaaaatacataatatgaattcagcttgtaaccagcatcagcttgtaaccagcatctacataaaaaaataaaacatttccagcatactaga

SEQ ID NO: 160537 - DNA, 3066 bp, Homo sapiens
  Payload ID: 11378
  Gene Symbol: NFRKB
  Gene Name: nuclear factor related to kappaB binding protein
  ENST ID: ENST00000531755
  CDS Start-End: 105-3066
caggattccagaattggaaataacgggagggaggacctggtccagcttcccttcctcaaataaggaaattgacacctggcgtgagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggccacgttggatttacaagaacaattttcttttgaagatctcagctcatggcttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagaaaatgaagacagctcagatgccacaacacctgtccctcggaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatgg

SEQ ID NO: 160538 - DNA, 4114 bp, Homo sapiens
  Payload ID: 11378
  Gene Symbol: NFRKB
  Gene Name: nuclear factor related to kappaB binding protein
  Uniprot ID: Q6P4R8
  ENST ID: ENST00000524746
  CDS Start-End: 194-4093
caggattccagaattggaaataacgggagggaggacctggtccagcttcccttcctcaaataaggaaattgacacctggcgtgagaaggggttttgccatgttcgctaggctggtctcaaactcatggattcaaggggactgcccgcctggacctcccaaagtactgagattagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggatctcagctcatggcttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttcc

SEQ ID NO: 160539 - DNA, 895 bp, Homo sapiens
  Payload ID: 11378
  Gene Symbol: NFRKB
  Gene Name: nuclear factor related to kappaB binding protein
  ENST ID: ENST00000530278
  CDS Start-End: 117-559
gtgcgcgcacccagactccttgcgggagcgagtgcgtctgggagcccgcggccggagaagggctgcgggttagggggccggcgcccgcggttcagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggccacgttggatttacaagaacaattttcttttgaagatctcagctcatggcttccgagctctccagcacgttctcctagtcctgcggtgcccctgcgggtggtgcccacactttcaaccacggatatgaaaactgcagg

SEQ ID NO: 160540 - DNA, 564 bp, Homo sapiens
  Payload ID: 11378
  Gene Symbol: NFRKB
  Gene Name: nuclear factor related to kappaB binding protein
  ENST ID: ENST00000531318
  CDS Start-End: 425-564
attttagtatgctttttagcccactttgtaggaataggagctggaaaggatggatttagtaaatgttggtagagtgattgagtttaagctccctgtggtcctgttagcattgtgcagtcctgtgctatcaacttgacccctaatcccagccatcagtctgaaaatgttgtggtatgtagttttctgaaggtgatcagcagtgttctgttattacacgaaggagaaaagtagcattaatttacatgattatacggatcaaatggaccaactaaaggcagattggccattgactttactggtggttatggtcagtctcattttactcatctgtaaaatgaaggcatatgaaatttatgaatttaggagttactgtaggagcattctgagaaaagagctcttccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatgtgag

SEQ ID NO: 160541 - DNA, 843 bp, Homo sapiens
  Payload ID: 11378
  Gene Symbol: NFRKB
  Gene Name: nuclear factor related to kappaB binding protein
  ENST ID: ENST00000529319
  CDS Start-End: 280-843
gcacccagactccttgcgggagcgagtgcgtctgggagcccgcggccggagaagggctgcgggttagggggccggcgcccgcggttcaggattccagaattggaaataacgggagggaggacctggtccagcttcccttcctcaaataaggaaattgacacctggcgtgagaaggggttttgccatgttcgctaggctggtctcaaactcatggattcaaggggactgcccgcctggacctcccaaagtactgagattagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacc

SEQ ID NO: 160542 - DNA, 4351 bp, Homo sapiens
  Payload ID: 11378
  Gene Symbol: NFRKB
  Gene Name: nuclear factor related to kappaB binding protein
  Uniprot ID: Q6P4R8
  ENST ID: ENST00000524794
  CDS Start-End: 122-4096
gctgtttagctgtaattagggtgcaaggataaggtgtaagaactggctggaggttgaatgttttcctggaggagtgttagcatcaactagatccctggaatttctgcctttctgtctcaagatgcatgtctttgtccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgagacggacactttaaccccgaggtggtcaagtaccggcagttatgcttcaagtcacagtacaagcgctacctcaactcccagcagcagtatttccatcggctgctgaagcaaattcttgcttcccggagtgatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagaggccacgttggatttacaagaacaattttcttttgaagatctcagctcatggcttccgagctctccagcacgttctcctagtcctgcggtgcccctgcgggtggtgcccacactttcaaccacggatatgaaaactgcagataaagtagaactgggggacagtgacctgaagataatgttaaagaagcaccacgagaagcggaaacatcagccagatcacccggaccttttgacaggggacctgactctcaatgacatcatgactcgagtaaatgctggcaggaagggctctctggcagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagccccttgaagacctcaagccttgccttggaatcaatgaaatatcttccagcttcttctctcttctattagagatcttgctgctggagagtcaggctagccttcctatgctagaggagcgagttttggattggcagtcatcgccagccagctccctcaacagctggttctctgcggcccccaactgggctgagttggtactaccagccctgcagtatcttgctggagaaagtcgagctgttccttccagtttctctccatttgttgaattcaaagagaaaacccagcagtggaagttgcttggccaatcccaagataatgaaaaggaattagctgccctcttccagctatggctagagaccaaagatcaggccttctgtaagcaagaaaatgaagacagctcagatgccacaacacctgtccctcgggtaagaactgactatgtggtgcgtcccagcacgggggaggagaaacgggtttttcaggagcaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttgttcgggacgctgcggctcgactgcctaatggagaaggcacacgggcagagatctgtgaactgcttaaggactcccagtttcttgcaccagatgtcaccagcactcaggtaaatacagtagtgagtggtgcactggatcggctacattacgaaaaagatccctgtgtgaaatacgacattggacgaaagctgtggatctacctgcatcgtgaccggagtgaagaagagtttgagcggattcaccaagcacaagcagctgcagctaaagccagaaaagctcttcagcaaaaacccaagcccccatccaaggtgaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcgggtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcag

SEQ ID NO: 160543 - DNA, 1658 bp, Homo sapiens
  Payload ID: 11379
  Gene Symbol: NFE2
  Gene Name: nuclear factor, erythroid 2
  Uniprot ID: Q16621
  ENST ID: ENST00000312156
  CDS Start-End: 274-1395
gcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaa

SEQ ID NO: 160544 - DNA, 1762 bp, Homo sapiens
  Payload ID: 11379
  Gene Symbol: NFE2
  Gene Name: nuclear factor, erythroid 2
  Uniprot ID: Q16621
  ENST ID: ENST00000435572
  CDS Start-End: 378-1499
atcgggctcaagtttcctctcttggccgaaaggggcaggaggagaggagagccacggggaaaggggagggttggaggaaggactgagaactcaggccgagggcttcagacgctggtgcgcctgcttggggctcctgtgctcagctcagcctgagcttccacactcagcgctcagcaatggcccgggggcggggcgcggtcctcgcagattctcaaaggtagccgggatcctcgtccagcagtgtcagctcaggctcagcctccccagagacaacaccgggagcctcatctctctcctcaccctgctgtgactccaccacaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaa

SEQ ID NO: 160545 - DNA, 1833 bp, Homo sapiens
  Payload ID: 11379
  Gene Symbol: NFE2
  Gene Name: nuclear factor, erythroid 2
  Uniprot ID: Q16621
  ENST ID: ENST00000540264
  CDS Start-End: 511-1632
atatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtaaagacctcctgtgctaccaaaggaactgactgtggccatagttggcgaggtggagatcacaacacaggaaaagactttccatcttaagggattgatgaatccagcatgagtgaggatggggaggaggcggtctctccttccctcaggggaagctggagggagcccctccaaggaggtagtgcaaacttgctgaccctagcaggtgtagctctaacacctcttttcctttgacacaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcg

SEQ ID NO: 160546 - DNA, 1208 bp, Homo sapiens
  Payload ID: 11379
  Gene Symbol: NFE2
  Gene Name: nuclear factor, erythroid 2
  ENST ID: ENST00000553198
  CDS Start-End: 178-1208
ggatggaggcaagggctaggggagatactctttcaaaaggatcatttgtagttcctactaattttgtggtaagtcgaagagaagattccatattaaattgctgtgatgggccatccttgtggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacag

SEQ ID NO: 160547 - DNA, 1523 bp, Homo sapiens
  Payload ID: 11379
  Gene Symbol: NFE2
  Gene Name: nuclear factor, erythroid 2
  Uniprot ID: Q16621
  ENST ID: ENST00000553070
  CDS Start-End: 402-1523
agacgctggtgcgcctgcttggggctcctgtgctcagctcagcctgagcttccacactcagcgctcagcaatggcccgggggcggggcgcggtcctcgcagattctcaaaggtagccgggatcctcgtccagcagtgtcagctcaggctcagcctccccagagacaacaccgggagcctcatctctctcctcaccctgctgtgactccaccacaggggcagtagagatcagctggacctggagggagaaggaagacatcccaaccccagcatagttgcttctaactggaactcttggctgcttgggaaataggggcttgggaagcagtggaagagaagagaggaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactga

SEQ ID NO: 160548 - DNA, 4672 bp, Homo sapiens
  Payload ID: 11380
  Gene Symbol: NFE2L1
  Gene Name: nuclear factor, erythroid 2-like 1
  Uniprot ID: Q14494
  ENST ID: ENST00000357480
  CDS Start-End: 606-2834
ccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattc

SEQ ID NO: 160549 - DNA, 4774 bp, Homo sapiens
  Payload ID: 11380
  Gene Symbol: NFE2L1
  Gene Name: nuclear factor, erythroid 2-like 1
  Uniprot ID: Q14494
  ENST ID: ENST00000362042
  CDS Start-End: 617-2935
aagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattca

SEQ ID NO: 160550 - DNA, 4729 bp, Homo sapiens
  Payload ID: 11380
  Gene Symbol: NFE2L1
  Gene Name: nuclear factor, erythroid 2-like 1
  ENST ID: ENST00000361665
  CDS Start-End: 605-2890
agggaagtagcacttgttcgctggccgcccctggaggctagaagctccggcgccgagagtgggcatggcgacttggtctcagccggactcgggtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattca

SEQ ID NO: 160551 - DNA, 2172 bp, Homo sapiens
  Payload ID: 11380
  Gene Symbol: NFE2L1
  Gene Name: nuclear factor, erythroid 2-like 1
  ENST ID: ENST00000536222
  CDS Start-End: 310-2160
agcttgagcacggagcatggggtgggagtcccatctcactgcagcctctgcggtgagctcagggtgggggcagctgggcgcctgagtggaactggggttgtgaggtgggagggggctgctcaaggatggaggaagggggctggctgggccgcccaggcagcagcacgggcggggcaccctcctcaggcccctcggagctagcaaggggccacccttccagcctggtgtgctccctgaaagccaagagctccttgcagccccctgtccggcttcccggcaccggctgccctggggctcatctcgcagaccatgacccgcctggaccgcagctctcacagtggtgggggccatgccaaaggcagccggccccttaactctttgctggctggtcaccgggtggcccagcccgcctctgctcctgggtccagggcttctgttcaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaaga

SEQ ID NO: 160552 - DNA, 4390 bp, Homo sapiens
  Payload ID: 11380
  Gene Symbol: NFE2L1
  Gene Name: nuclear factor, erythroid 2-like 1
  Uniprot ID: Q14494
  ENST ID: ENST00000585291
  CDS Start-End: 316-2544
ggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaacaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaa

SEQ ID NO: 160553 - DNA, 481 bp, Homo sapiens
  Payload ID: 11380
  Gene Symbol: NFE2L1
  Gene Name: nuclear factor, erythroid 2-like 1
  ENST ID: ENST00000581319
  CDS Start-End: 1-402
tctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtagaggagctatgtggagcaaaggccgacagaggggaaggaatggacctgtgagaggaagggaaggtggcagaaagtctcatttcaggaaggagggatagaaggaaggaaggaaggaacccccccccccccg

SEQ ID NO: 160554 - DNA, 568 bp, Homo sapiens
  Payload ID: 11380
  Gene Symbol: NFE2L1
  Gene Name: nuclear factor, erythroid 2-like 1
  ENST ID: ENST00000579889
  CDS Start-End: 541-568
gagtgcggtagcaggagggggcggggaggtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacgg

SEQ ID NO: 160555 - DNA, 552 bp, Homo sapiens
  Payload ID: 11380
  Gene Symbol: NFE2L1
  Gene Name: nuclear factor, erythroid 2-like 1
  ENST ID: ENST00000581441
  CDS Start-End: 542-552
atgggtcacaacgcaggagaggagaggcggtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctct

SEQ ID NO: 160556 - DNA, 372 bp, Homo sapiens
  Payload ID: 11380
  Gene Symbol: NFE2L1
  Gene Name: nuclear factor, erythroid 2-like 1
  ENST ID: ENST00000579537
  CDS Start-End: 182-372
aaggagacggaggcggcccagggatgggctggttccttgcggcagcttctccagctgccctgatgcagagattggctcccgtctgcagctagcctggtgtgctccctgaaagccaagagctccttgcagccccctgtccggcttcccggcaccggctgccctggggctcatctcgcagaccatgacccgcctggaccgcagctctcacagtggtgggggccatgccaaaggcagccggccccttaactctttgctggctggtcaccgggtggcccagcccgcctctgctcctgggtccagggcttctgttcaggacatagatctgattgacatcctttggcgacaggatattgatctgggggctgggcgtga

SEQ ID NO: 160557 - DNA, 562 bp, Homo sapiens
  Payload ID: 11380
  Gene Symbol: NFE2L1
  Gene Name: nuclear factor, erythroid 2-like 1
  ENST ID: ENST00000577411
  CDS Start-End: 375-562
gattggctctcggcgcagcctaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccc

SEQ ID NO: 160558 - DNA, 588 bp, Homo sapiens
  Payload ID: 11380
  Gene Symbol: NFE2L1
  Gene Name: nuclear factor, erythroid 2-like 1
  ENST ID: ENST00000584634
  CDS Start-End: 531-588
gacctgggggaggggattggctctctgcagcctcagcagtgacctgcggggtgggagggggtggggattggctccctgctgcagcctaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgt

SEQ ID NO: 160559 - DNA, 2051 bp, Homo sapiens
  Payload ID: 11380
  Gene Symbol: NFE2L1
  Gene Name: nuclear factor, erythroid 2-like 1
  ENST ID: ENST00000583378
  CDS Start-End: 35-1756
gagcttgctttcctctgcagcttgagcacggagcatggggtgggagtcccatctcactgcagcctctgcggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggag

SEQ ID NO: 160560 - DNA, 529 bp, Homo sapiens
  Payload ID: 11380
  Gene Symbol: NFE2L1
  Gene Name: nuclear factor, erythroid 2-like 1
  ENST ID: ENST00000584137
  CDS Start-End: 282-529
aagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggct

SEQ ID NO: 160561 - DNA, 583 bp, Homo sapiens
  Payload ID: 11380
  Gene Symbol: NFE2L1
  Gene Name: nuclear factor, erythroid 2-like 1
  ENST ID: ENST00000580037
  CDS Start-End: 441-583
aagtaattctgcatgacaattcgctcttgcttgccatggccagcttcctccaaaccaagttttaaggggtccaatccccaaagctagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatca

SEQ ID NO: 160562 - DNA, 583 bp, Homo sapiens
  Payload ID: 11380
  Gene Symbol: NFE2L1
  Gene Name: nuclear factor, erythroid 2-like 1
  ENST ID: ENST00000577431
  CDS Start-End: 100-583
acccttccagcctggtgtgctccctgaaagccaagagctccttgcagccccctgtccggcttcccggcaccggctgccctggggctcatctcgcagaccatgacccgcctggaccgcagctctcacagtggtgggggccatgccaaaggcagccggccccttaactctttgctggctggtcaccgggtggcccagcccgcctctgctcctgggtccagggcttctgttcaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtga

SEQ ID NO: 160563 - DNA, 556 bp, Homo sapiens
  Payload ID: 11380
  Gene Symbol: NFE2L1
  Gene Name: nuclear factor, erythroid 2-like 1
  ENST ID: ENST00000585062
  CDS Start-End: 259-556
acttgttcgctggccgcccctggaggctagaagctccggcgccgagagtgggcatggcgacttggtctcagccggactcgggtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgagg

SEQ ID NO: 160564 - DNA, 512 bp, Homo sapiens
  Payload ID: 11380
  Gene Symbol: NFE2L1
  Gene Name: nuclear factor, erythroid 2-like 1
  ENST ID: ENST00000583210
  CDS Start-End: 444-512
aaggagacggaggcggcccagggatgggctggttccttgcggcagcttctccagctgccctgatgcagagattggctcccgtctgcagctaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccct

SEQ ID NO: 160565 - DNA, 476 bp, Homo sapiens
  Payload ID: 11380
  Gene Symbol: NFE2L1
  Gene Name: nuclear factor, erythroid 2-like 1
  ENST ID: ENST00000580050
  CDS Start-End: 142-476
agtgacctgcggggtgggagggggtggggattggctccctgctgcagcctagcctggtgtgctccctgaaagccaagagctccttgcagccccctgtccggcttcccggcaccggctgccctggggctcatctcgcagaccatgacccgcctggaccgcagctctcacagtggtgggggccatgccaaaggcagccggccccttaactctttgctggctggtcaccgggtggcccagcccgcctctgctcctgggtccagggcttctgttcaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagctt

SEQ ID NO: 160566 - DNA, 1998 bp, Homo sapiens
  Payload ID: 11380
  Gene Symbol: NFE2L1
  Gene Name: nuclear factor, erythroid 2-like 1
  ENST ID: ENST00000582155
  CDS Start-End: 52-1806
aggataggcccaggagggagcttgctttcctctgcagcttgagcacggagcatggggtgggagtcccatctcactgcagcctctgcggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagt

SEQ ID NO: 160567 - DNA, 2853 bp, Homo sapiens
  Payload ID: 11381
  Gene Symbol: NFE2L2
  Gene Name: nuclear factor, erythroid 2-like 2
  Uniprot ID: Q16236
  ENST ID: ENST00000397062
  CDS Start-End: 556-2373
aaatcagggaggcgcagctcctacaccaacgcctttccggggctccgggtgtgtttgttccaactgtttaaactgtttcaaagcgtccgaactccagcgaccttcgcaaacaactctttatctcgcgggcgagagcgctgcccttatttgcgggggagggcaaactgaacgccggcaccggggagctaacggagacctcctctaggtcccccgcctgctgggaccccagctggcagtcccttcccgcccccggaccgcgagcttcttgcgtcagccccggcgcgggtgggggattttcggaagctcagcccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 160568 - DNA, 2651 bp, Homo sapiens
  Payload ID: 11381
  Gene Symbol: NFE2L2
  Gene Name: nuclear factor, erythroid 2-like 2
  Uniprot ID: Q16236
  ENST ID: ENST00000397063
  CDS Start-End: 402-2171
actttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaatta

SEQ ID NO: 160569 - DNA, 451 bp, Homo sapiens
  Payload ID: 11381
  Gene Symbol: NFE2L2
  Gene Name: nuclear factor, erythroid 2-like 2
  ENST ID: ENST00000430047
  CDS Start-End: 248-451
cccgcgcggccggcgggggaaggaagggcccggactcttgccccgcccttgtggggcgggaggcggagcggggcaggggcccgccggcgtgtagccgattaccgagtgccggggagcccggaggagccgccgacgcagccgccaccgccgccgccgccgccaccagagccgccctgtccgcgccgcgcctcggcagccggaacagggccgccgtcggggagccccaacacacggtccacagctcatcatgatggacttggagctgccgccgccgggactcccgtcccagcaggacatggatttgattgacaattatcatttttactcatctataccctcaatggaaaaagaagtaggtaactgtagtccacattttcttaatgcttttgaggattccttcagcagcatcctctccacagaagaccccaaccagttgacagtgaactcatta

SEQ ID NO: 160570 - DNA, 909 bp, Homo sapiens
  Payload ID: 11381
  Gene Symbol: NFE2L2
  Gene Name: nuclear factor, erythroid 2-like 2
  ENST ID: ENST00000449627
  CDS Start-End: 113-909
gttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaa

SEQ ID NO: 160571 - DNA, 975 bp, Homo sapiens
  Payload ID: 11381
  Gene Symbol: NFE2L2
  Gene Name: nuclear factor, erythroid 2-like 2
  ENST ID: ENST00000448782
  CDS Start-End: 135-975
atagcgtgcaaacctcgccgcgccagggccaagggacaggttggagctgttgatctgttgcgcaattgctattttccccagagcggctttgtctttggatttagcgtttcagaattgcaattccaaaatgtgacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagca

SEQ ID NO: 160572 - DNA, 1382 bp, Homo sapiens
  Payload ID: 11381
  Gene Symbol: NFE2L2
  Gene Name: nuclear factor, erythroid 2-like 2
  ENST ID: ENST00000423513
  CDS Start-End: 56-481
attgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtgaggtataaaataacctggttaatagaaaaactccatcataactataaaataacaatctattctatgtaagtcccgtcaatgaatctccatttaaaagaataaaaacatttttaggaggaaattttttaaccaaggaaatactcttgtcaaggaaaccttagcctataaataactttacaattaagaaaaaaaaaaacccttcacacaatacaaaaccaaaaccattgactattgcatagccagaaacatggacagcataaccatggaaacaaataacccatttgctgcaagtatctaagaggtttggtgagtaaagagccagctgggcaataaacgaagacttgttcagttaacaattttaataaatctgttttatctagtaccactgtgctagatattatataaactaaatcctaaagattgtacttacgcattttaaagtttactttcaaatgcttaagctgaaacagaccagcaaattataaatttgagtcagtggggtaggaaaaaaagatttgttatttacaaacggggtcatgactggttagtaagtagagagacacagaactgcagctgattccattttgttttgtagtggtgccttagagcttactcatcccctgttggtggaagactcataaatcaatgccttatcaattttaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacaggtaactaaaatagaatgtaatactggagattttttttatattcagtgcctttagtcattctgattatttatataccacctatttataggaaggattggagggtgctattaactta

SEQ ID NO: 160573 - DNA, 2399 bp, Homo sapiens
  Payload ID: 11381
  Gene Symbol: NFE2L2
  Gene Name: nuclear factor, erythroid 2-like 2
  Uniprot ID: Q16236
  ENST ID: ENST00000446151
  CDS Start-End: 174-1922
gctttatagcgtgcaaacctcgccgcgccagggccaagggacaggttggagctgttgatctgttgcgcaattgctattttccccagagcggctttgtctttggatttagcgtttcagaattgcaattccaaaatgtgtaagacgggatattctcttctgtgctgtcaagggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaa

SEQ ID NO: 160574 - DNA, 979 bp, Homo sapiens
  Payload ID: 11381
  Gene Symbol: NFE2L2
  Gene Name: nuclear factor, erythroid 2-like 2
  ENST ID: ENST00000421929
  CDS Start-End: 276-979
actttctcggccggggaggggttcgggctcgggcacccggagttggcccctcgtaacgccgcgggaaagtgcgggcgagggcagtggactctgaggccggagtcggcggcacccggggcttctagttcggacgcggtgccccctggtggcgctcaccgcgcgcgtggccttggcttccgtgacagcgctcggttggccgtcacagcagccctcggttggccctttcctgctttatagcgtgcaaacctcgccgcgccagggccaagggacaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttga

SEQ ID NO: 160575 - DNA, 455 bp, Homo sapiens
  Payload ID: 11381
  Gene Symbol: NFE2L2
  Gene Name: nuclear factor, erythroid 2-like 2
  ENST ID: ENST00000458603
  CDS Start-End: 1-144
acttctgttgctcaggtagcccctgttgatttagacggtatgcaacaggacattgagcaagtttgggaggagctattatccattcctgagttacagtggagacagggtttcaccatgttgaccagggtggtatggaactcctgacctcaagtgatctgcctgccttggcctcccaaagtgctaggattacacgggagccaccacaccaagccaagtgtgaagatttggggtcctgaatatttttcacgtgctatcaaggaacttccttcctctgatggtgtggtgatggggaatctcgggagaagacatcacttttccaaactcagaacataatcccaggtcttgaacaaactgtctattcttagaccaaattgtgagtgcagagatggtggcaagaatctcagcagcagctatctggagcacctaacattgactgatatttgaagggggaagag

SEQ ID NO: 160576 - DNA, 942 bp, Homo sapiens
  Payload ID: 11381
  Gene Symbol: NFE2L2
  Gene Name: nuclear factor, erythroid 2-like 2
  ENST ID: ENST00000586532
  CDS Start-End: 148-942
ggctttctaacaagctcccagtagagatggggtttcaccatgttgcccaggctggtctcaaactcctgagctcaggccatctgcccgcctcggcctcccaaagtgctaggattacagaaggtgcctgcttccccttcaccttccaccatgattgtaagtttcctgaggcctccccagacatgtggaactgacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttg

SEQ ID NO: 160577 - DNA, 2749 bp, Homo sapiens
  Payload ID: 11381
  Gene Symbol: NFE2L2
  Gene Name: nuclear factor, erythroid 2-like 2
  Uniprot ID: Q16236
  ENST ID: ENST00000464747
  CDS Start-End: 503-2272
cccggcagccaccgcggcgacttggcggcgggtgccatgcgtctggagcttcacattctctgccccccacccaccgcgccggcgctcccttgtcacgcctcgggaagcgcgcacctgccaagcaggatgaataatctgatatcatgtgaaatgaggaaataagaagctttctgctgacttcattttgacccagggtccaaaaggtgatgtaatcctgtggcaagaagattcaaaactgtggactatcttgcaaaaaatacaagaagatattgaaagttttcatgagtgcctaccacctaatctcaaacactatcattcatatgtgcctcattgagcaaatctttaatgaggatctatatgccagaaacagaaagtacatgatggacttcattgaaggatggagatttggaagacatgaatggatgaagaaccaagtgcgtgagggcacctatcaggattattgctgaaatccttatggagttaactggctgagaggaaggacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctcagtcacctgaaacttctgttgctcaggtagcccctgttgatttagacggtatgcaacaggacattgagcaagtttgggaggagctattatccattcctgagttacagtgtcttaatattgaaaatgacaagctggttgagactaccatggttccaagtccagaagccaaactgacagaagttgacaattatcatttttactcatctataccctcaatggaaaaagaagtaggtaactgtagtccacattttcttaatgcttttgaggattccttcagcagcatcctctccacagaagaccccaaccagttgacagtgaactcattaaattcagatgccacagtcaacacagattttggtgatgaattttattctgctttcatagctgagcccagtatcagcaacagcatgccctcacctgctactttaagccattcactctctgaacttctaaatgggcccattgatgtttctgatctatcactttgcaaagctttcaaccaaaaccaccctgaaagcacagcagaattcaatgattctgactccggcatttcactaaacacaagtcccagtgtggcatcaccagaacactcagtggaatcttccagctatggagacacactacttggcctcagtgattctgaagtggaagagctagatagtgcccctggaagtgtcaaacagaatggtcctaaaacaccagtacattcttctggggatatggtacaacccttgtcaccatctcaggggcagagcactcacgtgcatgatgcccaatgtgagaacacaccagagaaagaattgcctgtaagtcctggtcatcggaaaaccccattcacaaaagacaaacattcaagccgcttggaggctcatctcacaagagatgaacttagggcaaaagctctccatatcccattccctgtagaaaaaatcattaacctccctgttgttgacttcaacgaaatgatgtccaaagagcagttcaatgaagctcaacttgcattaattcgggatatacgtaggaggggtaagaataaagtggctgctcagaattgcagaaaaagaaaactggaaaatatagtagaactagagcaagatttagatcatttgaaagatgaaaaagaaaaattgctcaaagaaaaaggagaaaatgacaaaagccttcacctactgaaaaaacaactcagcaccttatatctcgaagttttcagcatgctacgtgatgaagatggaaaaccttattctcctagtgaatactccctgcagcaaacaagagatggcaatgttttccttgttcccaaaagtaagaagccagatgttaagaaaaactagatttaggaggatttgaccttttctgagctagtttttttgtactattatactaaaagctcctactgtgatgtgaaatgctcatactttataagtaattctatgcaaaatcatagccaaaactagtatagaaaataatacgaaactttaaaaagcattggagtgtcagtatgttgaatcagtagtttcactttaactgtaaacaatttcttaggacaccatttgggctagtttctgtgtaagtgtaaatactacaaaaacttatttatactgttcttatgtcatttgttatattcatagatttatatgatgatatgacatctggctaaaaagaaattattgcaaaactaaccactatgtacttttttataaatactgtatggacaaaaaatggcattttttatattaaattgtttagctctggcaaaaaaaaaaaattttaagagctggtactaataaaggattattatgactgttaaa

SEQ ID NO: 160578 - DNA, 814 bp, Homo sapiens
  Payload ID: 11381
  Gene Symbol: NFE2L2
  Gene Name: nuclear factor, erythroid 2-like 2
  ENST ID: ENST00000588123
  CDS Start-End: 376-814
atactgaatgtccatggagagtttaacataaggaagaagaggcctgtctcccagctgaaactggtgcagcagatcatgcaaagtaaaacctcagcagctgtgatgaagtagagcagagggcctgggtgtctgtcagctccaagcggaagatttccccagctttctagatttctgacttcatatctgtgggatccacacaatggggaggtactggccttggaatccatggttccccagctatcattttactttagaattacagtgttctctgttagtgtcaagggaatgaacctgacgagaaaagaccaaacataggactgttacagggaagaaaaatatgaaaagacctaaagatgcacgtcctcattatatgacatggatttgattgacatactttggaggcaagatatagatcttggagtaagtcgagaagtatttgacttcagtcagcgacggaaagagtatgagctggaaaaacagaaaaaacttgaaaaggaaagacaagaacaactccaaaaggagcaagagaaagcctttttcgctcagttacaactagatgaagagacaggtgaatttctcccaattcagccagcccagcacatccagtcagaaaccagtggatctgccaactactcccaggttgcccacattcccaaatcagatgctttgtactttgatgactgcatgcagcttttggcgcagacattcccgtttgtagatgacaatgaggtttcttcggctacgtttcagtcacttgttcctgatattcccggtcacatcgagagcccagtcttcattgctactaatcaggctc

SEQ ID NO: 160579 - DNA, 3686 bp, Homo sapiens
  Payload ID: 11382
  Gene Symbol: NFE2L3
  Gene Name: nuclear factor, erythroid 2-like 3
  Uniprot ID: Q9Y4A8
  ENST ID: ENST00000056233
  CDS Start-End: 260-2344
gggctcggcgctcaggtggctccttcttcgcttctcccgatccccggcggtgccaggcacggtgccggctgccgagggaacgcctttgtgcccggtgctgggaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacagaatctgaaccaaatttaccttactttccttccaaaatatccacattcaggaatataggtgaataacaaataaggcagcatagcaaactgctcagactcaagccaaattgaggtcaacatagtatgccaaatccatagtaaggcaaatccacccccctaccccaatacttaacacacagaatactatgtgatatagaatgcactgaagacctacggtcactggtagtttgagccacaggccttcctcatgtaaccagagacagaatgggctacttgcaaaaacgtaactccttgtgtgtatattaaatccataaaatctctggcagtaaagccagcctgaagggatggcctcaccatcttagaatactgagatctcaccagaacactgtaagccatataaacagtagggaaagagtcagcaacagtgaaaccatctgtttaaaatgggcaaaagcgattaagggaaaaaaaacaggtgaatttgaaaataaaccagggtaaggtaaattctagaaataatagcatttgaaatgaaaacctcacttaagttcactagaacagtaaacaggagattgctgaattttttgaagacagcaatgacctcacctagatgactcaagtttggggaacatcaagattttgacgggtactataatgcttaatatgtccaaattttcaaaatgaagtttctcagatattatttctgccataggagctacagtgtagagtatcacataagtatcttgggctagagaaatgcagtttatatataccgttggatttttataataaagtttcccaagacctgtta

SEQ ID NO: 160580 - DNA, 294 bp, Homo sapiens
  Payload ID: 11382
  Gene Symbol: NFE2L3
  Gene Name: nuclear factor, erythroid 2-like 3
  ENST ID: ENST00000607375
  CDS Start-End: 1-252
aatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggaggtaattggaactttggcttttatcctcgcaggaacatatctgcactgaccttttggtgaacaaatacaactcctttacttggatgacaca

SEQ ID NO: 160581 - DNA, 2085 bp, Homo sapiens
  Payload ID: 11383
  Gene Symbol: NFIL3
  Gene Name: nuclear factor, interleukin 3 regulated
  Uniprot ID: Q16649
  ENST ID: ENST00000297689
  CDS Start-End: 396-1784
acgtagcgcggcgctcggaactgacctactaacacacatctctccgcgcggccacggcgcccgcggacccggcgcgcccgcccgcctcccgcgccgcgccctcgccgccgcccgcctcccgccgcggccccggaggcccggcccggcccgagccccgagcgccggcggcccgactcccggccgcccctttctttctcctcgccggcccgagagcaggaacacgataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacagaa

SEQ ID NO: 160582 - DNA, 3492 bp, Homo sapiens
  Payload ID: 11384
  Gene Symbol: NUFIP1
  Gene Name: nuclear fragile X mental retardation protein interacting protein 1
  Uniprot ID: Q9UHK0
  ENST ID: ENST00000379161
  CDS Start-End: 48-1535
aatgcttgctccacagtcgcgtgctagactccggacccgccagtggtatggctgagccgactagtgatttcgagactcctatcgggtggcatgcgtctcccgagctgactcccacgttagggcccctgagcgacactgccccgccgcgggacagctggatgttctgggcaatgctgccgccaccgccaccaccacttacgtcctcgcttcccgcagccgggtcaaagccttcctctgagtcgcagccccccatggaggcccagtctctccccggggctccgccccccttcgacgcccagattcttcccggggcgcaaccccccttcgacgcccagtctccccttgattctcagcctcaacccagcggccagccttggaatttccatgcttccacatcgtggtattggagacagtcttctgataggtttcctcggcatcagaagtccttcaaccctgcagttaaaaattcttattatccacgaaagtatgatgcaaaattcacagacttcagcttacctcccagtagaaaacagaaaaaaaagaaaagaaaggaaccagtttttcactttttttgtgatacctgtgatcgtggttttaaaaatcaagaaaagtatgacaaacacatgtctgaacatacaaaatgccctgaattagattgctcttttactgcacacgagaagattgtccagttccattggagaaatatgcatgctcctggcatgaagaagatcaagttagacactccagaggaaattgcacggtggagggaagaaagaaggaaaaactatccaactctggccaatattgaaaggaagaagaagttaaaacttgaaaaggagaagagaggagcagtattgacaacaacacaatatggcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctgagtctgataaggaggagaaaccacaacattctgtgatacccaaggaagtgacaccagccctatgctcactaatgagtagctatggcagtctttcagggtcagagagtgagccagaagaaactcccatcaagactgaagcagacgttttggcagaaaaccaggttcttgatagcagtgctcctaagagtccaagtcaagatgttaaagcaactgttagaaatttttcagaagccaagagtgagaaccgaaagaaaagctttgaaaaaacaaaccctaagaggaaaaaagattatcacaactatcaaacgttattcgaaccaagaacacaccatccatatctcttggaaatgcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttttttccgtcaaaattggatttgtaattaaattgtaagcctcgtaggatgtatgttggaattttaagtctttcctttggttctatgcaaataaaaaaataactgattttttaagactgtgtctgtattgttgggattgaatctagtatttgctgggagaattttttctttgtatttattttaatgtattgttctcatgtaagaatgactgatgttgtgttagttaagaattgaagataggtttagcagtaaagaagaaagcttttaaaaggattgattcagctaagcaaagttgggcagagaaatacagccattttgtttttaatgcagaaaaggaagatgttctgtagcaagggggaatattttaaaaataaaccagatcaaattaatacaatcagaaggtttcgaaatgtaaatattccttatttaagacatgtttaaattcacctactagcacgacttacatagctcaaatattgaatgtttaaaatattaatacagatggggcctctttatgtttagataaaattgaagtacttaattgaagctttttaaaaattgtaaagtaaatgaaagctattgagatctttttgtctcctataataccagggaatttgagcttgtgttctagtcattgtactagctgtagctattggtctgtccttttgacatacagctaaaagggactaaatttgtaaaaaattagtttgttatagttgaagattaacttttcctaacattgtgattattgaagttcatgaatcttgctgtcaaggaagaaaggtaagaaagctgatagctcctccatgttggtaaaatcctctccagaatcttggaacacctggcatgtgaccctagtgacgtcacagacctgagatgaagattcatgtttagccagtgttttccagccttgtacccaccatacagatctgtttattctgtttcaccctactcctccagtgagccccatattttgggaaattatctgccttatacattaactaattcaattcatgtaacactgttgagtgcttactctttgtacctctattgtgcctatattaaaggtatacaaataaataaggccatgtctgacttcaaggaactcagtttaattttgatatattcaaagatgtgattcccaaccaactcaggatgaagtaactagtgttacaactgagttgatattctaaaatataacacagtttgtacttttattactagttagcatacacattttataggcttatgggttaataaatgaattcatggactcctggactactttcattgatgaccatatctccagggatgttgttgatccccacactgccttaaggtatattatagaaacagttttattttccatttttcttgtttcctgataataaatgtatttaggactgaaaatactcctgagtactcccttggctgtatgtctgacagtctttagctatggtgactattgtttatttttaatgggtatttcagattccaagtgtatttaaaatttctaaggagatataatatagcctgtatggtttctactttatggaattatatggtcaatatttgtaaatattctatgagttttgggtgggtagaggggtgctttgcctgttttgggtacaggtttttttggatttagcttgttaattgttcaaactttctgccttctacattcctatcttattgttcgtttaatcagtttctgaaatgtaagcattacatgactattggtgagttgtgccttttataactgaaatactttactttttctcatatcctctataattgacttctattttccttaatcaaaccagctctgggaaatttaatacatttatattaattgagattattaaaacatttggactatt

SEQ ID NO: 160583 - DNA, 10850 bp, Homo sapiens
  Payload ID: 11385
  Gene Symbol: NUFIP2
  Gene Name: nuclear fragile X mental retardation protein interacting protein 2
  Uniprot ID: Q7Z417
  ENST ID: ENST00000225388
  CDS Start-End: 60-2147
ctcagatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagccacaaccaccaccaccaccatcatcaccagcagcctcaccaatacctgcagcatggagccgagggcagccccaaggcccagccaaagccgctgaaacatgagcagaaacacaccctccagcagcaccaggaaacgccgaagaagaaaacaggctatggtgaactaaacggtaatgctggagaaagagaaatatctttaaagaacctgagttctgatgaagccaccaaccctatttccagggtcctcaatggcaaccagcaagttgtagacactagcctgaagcagactgtaaaggccaacacctttgggaaagcaggaattaaaaccaagaatttcattcagaaaaacagtatggacaaaaagaatgggaagtcttatgaaaataaatctggagagaatcagtctgtagataagtctgatactataccaattccaaatggtgtggtaacaaataattctggttatattactaatggttatatgggtaaaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacacccatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaagaaatggaatctatttggaatttgcagaagcaagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagttgatctgttttctgattattttgtgtaagcttctaaacaaacttcagctgtgattaatttagcacatttaaataacgtgttattgtttggtataaagaattttccttcaactcagagtattagtactgtagcataaaccaaatacagtctagaggggatttttaacatccctccattataaagactgaaaaaggggtgtgtgtgtgtgtgtgtgtttatgtatgtatgtatgtgtgtgtgaggaaaagatggagatattaaaaattagtaaatgaatgtgtataagacattagtattcagagaatgaacttgtatttattttgtgccatttgttttcattacacagaaaaaagtcaggtggtttaaatccttaaaagggtagtattgaaaaatggcactaagaatgaaattatgacctatttttttaatagctatgaagatactaattatgggtgaagatttctttttaaatctgttttgattattgtaggcttctgtgtcacataccactcttgtaggtgtcctcaataatccccttttcccacaaaatacacagggtgtattatctttctctttattcacccccactttgctgaactgaagttaattacatagcctttcttctaacctccttagtaatgaaccttcacataaagtgtatttacagcgtctgtggtagccagcccttcctcctctactttctaggaggggatagccaataactaggaatttaatgacagatttttttttctttgaaataaatggccagagtttctccattttagaattttgttgtcctccttaatcatctgcttacctagtcattactcaatctgcagaaacttcataaaggaaaagtgctgcattgtttttacaaataacagtttgtagggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaatttccaggtattattagtatagttatgccgctgggccacatcctcaacaacagctgatccctcttgtataaatatgttaactgtgcagaacagttatgttatgggacaaatataatggtcattatggtcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatcccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggtttaaaggtaggataggcttttacctttattgctttagcataaatttggtttactgaattgactggcttgagattagaattattcagttgtttgtaagatcaaagcactggttgttttaaagataacgtgtatcttttaaaaaattgcccaagctgattagaacaagtttaggagttgggtacatttggttcaagtgctgcaatctgtatgtactaaatagctttactttgtgtatgtgtacttataatgtgtagatgtactactacccaggttttgtcaaatcatcttttttaaagtttttttttttttaattggttcaggacctttgtaggagaggctaatatgtttaagtagaagatattactgatagcattttccccatgctcctacataaaaaataaatatttccattttatagctttttcaatatacagaagagggttacttcttcatcaagtatattgttgcctttgaggacacagcaaaacccttctatatgtatcttcattgatagtggcagttaaaaactaagttatccagttaagacttaaaaggtgacccatattaattgcatggccttaaaaggcagaaatgcaggagtgtagcaagcatcattttagatggctatggttcctcttccgcatctgtcagtagttcacttatgttcagtcttagaacctactggaggagtgaagtaatttctctgtctcgtgcagaggcactaaggagctgagttacctcttaatctgggggaatggataataagtggagtacagttatgttaaaggatgttccccccgctcaaaaaaaagtttcaatgtttgttttgcccagtcaaaaatataggtcttttctacatataagaacagtcaccagaaattttcccttttgctaaatgcttaggtatttgctatagctgtttctgatgtcatggattctgaggaagtgtcatttacgtgatgatcttcctttattgatgtcttcatcatgttcagtgttttaaaaatataaattacaaacactctacaaccatacccagatttacttattttatcagaaaaaaaacttgagaaatttgtagatcaaattgagagacaataagtgtacattgttgaataaaaaattttaaagtttctga

SEQ ID NO: 160584 - DNA, 559 bp, Homo sapiens
  Payload ID: 11385
  Gene Symbol: NUFIP2
  Gene Name: nuclear fragile X mental retardation protein interacting protein 2
  Uniprot ID: Q7Z417
  ENST ID: ENST00000579665
  CDS Start-End: 57-419
agatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagccacaaccaccaccaccaccatcatcaccagcagcctcaccaatacctgcagcatggagccgagggcagccccaaggcccagccaaagccgctgaaacatgagcagaaacacaccctccagcagcaccaggaaacgccgaagaagaaaacagaaatggaatctatttggaatttgcagaagcaagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatat

SEQ ID NO: 160585 - DNA, 352 bp, Homo sapiens
  Payload ID: 11386
  Gene Symbol: NUGGC
  Gene Name: nuclear GTPase, germinal center associated
  ENST ID: ENST00000418860
  CDS Start-End: 123-352
gctgccaccatctcctctgtggactcctgtaaccaaaccagaactttttttttttttttctgttcagtgacatctggctggttctcctgaactgagaagagcaggagttcacgtaacaaggaatggcagaaacgaaggatgtttttggccaggaaccgcatccagttgaagatgatttatataaagaacgaacgagaaaaagaaggaaatcagatcgagaccagcggttccgagcatttccctccatggagcagagtgctcttaaggaatacacctcctttggagacctagtactttatccctgccaggtacctgcaggtgacatctctctgttaattccagatgaaaaatt

SEQ ID NO: 160586 - DNA, 3887 bp, Homo sapiens
  Payload ID: 11386
  Gene Symbol: NUGGC
  Gene Name: nuclear GTPase, germinal center associated
  Uniprot ID: Q68CJ6
  ENST ID: ENST00000413272
  CDS Start-End: 144-2534
aaatacctgaaccaaggagaagctgccaccatctcctctgtggactcctgtaaccaaaccagaactttttttttttttttctgttcagtgacatctggctggttctcctgaactgagaagagcaggagttcacgtaacaaggaatggcagaaacgaaggatgtttttggccaggaaccgcatccagttgaagatgatttatataaagaacgaacgagaaaaagaaggaaatcagatcgagaccagcggttccgagcatttccctccatggagcagagtgctcttaaggaatatgaaaaattggaatcacggaccagaagggttttgagcaacacttatcagaaacttattcagtctgtcttcctggatgacagcatccctaatggagtcaagtatctcataaataggcttcttgccttgattgaaaagccgacagtggacccaatctacattgcattatttggaagcactggggctgggaagagctccctgatcaatgccatcatccagcaagcaatgtttctaccagtgtctggagaaagcatatgtacttcctgcattgtacaagtgagctctggctgctgtgtgcagtatgaggccaaaatccaccttctgtctgaccaggagtggagggaggagctgaagaacctgaccaaactcctgcataggacggaggagctgagcagagaagaggcagatgcgtggaacagggatgaggcagtggaggaagccacctggaagctacaaatgatttatggaaatggggcagagagtaagaactatgaggagttactgagggcgaagcccaaaaggaagatccccacctccagagtcatcaccctcaaggcggaagaggcagaagagctgtccatcaagctggacccctacatccgcacacagaggagagattgggatggagaggccgctgagatgcgcatctggcccttgatcaaacatgtggaagtgacacttcccaaatccgacctgatcccagaaggggtcgtgctggtggacatcccaggcacaggcgacttcaacagcaagagggacgagatgtggaaaaagaccattgacaagtgctcagtgatctgggtgatcagcgacatagagcgagtttctggggggcaagcccacgaagaccttctgaatgagagcatcaaagcctgccagcggggcttctgtagggacgtggccctggtggtcaccaagatggacaaactccacttgccagaatacctaagggaaagaaaggcaggaaatcaagctattcagagtcagcgagaggctgttttagaaagaaatgaaatgataaaactacaaaggactagaattctcaaggaaaaactgaagagaaaactgccagctgacttcaaggttctggaagcctcagatctggtgtatacagtcagcgcccaggagtactggcagcaggctctcctcaccgaggaggaaacggaaatccctaagttaagagaatacatcaggaagagcctcttggacaagaagaagaggacagtgaccaagtatgtgactgaagcctttggcctgttgctcctcacagatagtttcaactccacgcaaaacctgccgaatgaacacttgcacatgagtgtcctgcggagatttgcggaagagaaggttgagctgctggagaaggccatcgcacagtgcttcgcctgcatggagcagcctctgcaagaaggggtcaggaccgccaggacttcttaccgctgcatcctcagagcatgcttggtgaggagtaaaggaaaccaaggttttcatcagaccctgaaagctgtttgcctgaaaaatggcatctatgcctccaggactctggcgagaattgatctaaatgaagccctcactcagcccgtctatgaccagatcgaccctgtttttggaagcatttttaggacggggaagcccactggttcagctctgatgcctcacatagatgcttttaagcagtccctgcaggagaaaatgacagaaattgggataagaagtggctggaaatatgatagctgcaaaaaaaatttcctgatccaggagataagtgccatcctcgggggcctggaggaccacatcctcagaaggaagaggaggatctacgagtccctcactgcctctgtccagagtgacctgaagctctgttacgaagaggcagctcagatcacgggcaaaaaagcgtgtgagcggatgaaagatgccatcagaagaggagtggaccggcaggtggctgagggcatgtttgaaagggcccaggaaaggatgcagcaccagtttcagcagctgaagactggaatcgtggagaaggtgaagggcagcatcaccactatgctggcccttgcttcgtcccagggggatggcctctacaaggagcttgcagatgtcgggagtgaatacaaggagatggagaagctgcacagaagcctgagggaggtcgcggagaatgcacggctgaggaagggcatgcaagaattcctcctaagggcatcccccagcaaggctggcccccccgggacatcactgtaactcctggggcttagtcccaatggatgaaaaatcagcccagagccagagaattagaattactttttttgttcttaagagacaagatctatctacctctgttgcccaggctggagtgcagtggcaccatcacagctcactgcagcctcgaactcctaggctcaagcgatcctccagcctcagcctccagagcagctggggctacaggtacaggccaccacacctgggtaatttttttttttttttttttgagacagagtctcgctgtgtcacccaggctggaatgcagtggtgcaatctcggctcactgcaacctccacctcctgggttcaagaaattctctgcctcagcctcccaagtagctgggattataggcgactgccaccacacccggttaatttttatatttttagtagagacggggtttcatcatcttggccaggctggtcctgaactcctgacctcgtgatccacccatctctgcctcccaaagtgctgggattacgggcatgagccaccgtgcccggcccatacctgggtaattttttaattttttgtggagatggcatcttgctctgttgcccagggtggtctcaaactcctggcctcaagtgattctctcccacctcagtctcttgtgctaggattgcaggcatgagccattgtgcctggctcagaattctttctgttttgtgaaatctaatagaggacatttctcaactatttggactttgcatgcaatataaaactagtatgtttactgcattttattttatagccccaaagagtcatcttcaatacctaatggagttctaaagctttagggcaagaaacttttgcttccgcaaaaacatctaaacatcgctgggcatggtggctcactcccgtaatcccagcactttgggaggctgaggcgggcggatcatgaggtcaggagattgagaccatcctggctaacacagtgaaaccccatctctactaaaaatacaaaaaattagccaggcgtggtagcatgtgcctatagtcccagctacttgggaggctgaggcaggagaatcgcttgaacccaggaggcataggttgcagtgagccaaggtcgcgccactgcactccagcctggacgacggagtgagactatgtctcaaaaaaaaaaaaaaaaaaagaaaaagaaaaaaatatatatatatacacacacacacccatacataaaaaaacttaaacattatagaaaaaacattgcacgatataaaacaagccataaaaagaaattcatccttcaataaagaaaaatatctaaacgttgaaaaacttaagtattatggaaaacattgcaaaataaagcttttaggaatccaa

SEQ ID NO: 160587 - DNA, 3775 bp, Homo sapiens
  Payload ID: 11387
  Gene Symbol: NUMA1
  Gene Name: nuclear mitotic apparatus protein 1
  Uniprot ID: Q14980
  ENST ID: ENST00000351960
  CDS Start-End: 173-3112
gtgctggagaggccgctgcgagcggaaggcctcctccataaccgagtccgaaagggcagaatctatgggggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 160588 - DNA, 7227 bp, Homo sapiens
  Payload ID: 11387
  Gene Symbol: NUMA1
  Gene Name: nuclear mitotic apparatus protein 1
  Uniprot ID: Q14980
  ENST ID: ENST00000358965
  CDS Start-End: 259-6564
gcccacgaagaggtacgattccggagaatcgcgaggcagagcgggagcgcgcagccaggtggaaactaattctaagccagactgctggagatcaccctgttctagtgtgtggaggcttccaccaggagtctggagtgcaatggcacgatctcggctcactgcaacctccacctcccaggttcaagcgattctcctgcctcagcctcccaagtagctgggattacaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 160589 - DNA, 583 bp, Homo sapiens
  Payload ID: 11387
  Gene Symbol: NUMA1
  Gene Name: nuclear mitotic apparatus protein 1
  ENST ID: ENST00000368959
  CDS Start-End: 310-583
aattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggagacagggtctctctctgtcacccagactggagtgcaatggcgggatctcagctcactgcaacctccacctctcgggttcaagcgattctcctgcctcagcctccctagtagctatgattacaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcag

SEQ ID NO: 160590 - DNA, 7343 bp, Homo sapiens
  Payload ID: 11387
  Gene Symbol: NUMA1
  Gene Name: nuclear mitotic apparatus protein 1
  Uniprot ID: Q14980
  ENST ID: ENST00000393695
  CDS Start-End: 333-6680
aagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 160591 - DNA, 539 bp, Homo sapiens
  Payload ID: 11387
  Gene Symbol: NUMA1
  Gene Name: nuclear mitotic apparatus protein 1
  ENST ID: ENST00000366394
  CDS Start-End: 314-539
agagcgggagcgcgcagccaggctggagtccagtggtgcaatctcggctccctgcaacctctgcctcctgggttcaagcgattctcctgcctcagcctcctgagtagctgggattacaggcatgcaccaccatgcccagctaattttgtatttttaatagaaatggggtttcaccatgttggtcaggctgatcttgaactgccaacctcaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccct

SEQ ID NO: 160592 - DNA, 583 bp, Homo sapiens
  Payload ID: 11387
  Gene Symbol: NUMA1
  Gene Name: nuclear mitotic apparatus protein 1
  ENST ID: ENST00000541719
  CDS Start-End: 336-583
gtgcggcctgggcacccctgcgggtgctcaggcctaaaaggggtgctggagaggccgctgcgagcggaaggcctcctccataaccgagtccgaaagggcagaatctatgggggtggaaactaattctaagccagactgctggagatcaccctgttctagtgtgtggaggcttccaccaggagacaggttctcactatgttgcccacgctggtctcaaattccttggctcaagtgatcctcccatcttggcctccaaaagtgccgggattacaagcatgagcaactgtgcctggccctgaaaaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatc

SEQ ID NO: 160593 - DNA, 582 bp, Homo sapiens
  Payload ID: 11387
  Gene Symbol: NUMA1
  Gene Name: nuclear mitotic apparatus protein 1
  ENST ID: ENST00000537930
  CDS Start-End: 104-582
ggatttagtgggtggccgtgtcccagagcagggcaggcggtgcccatggaaggtggcagggcgctttgtgtgcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctg

SEQ ID NO: 160594 - DNA, 874 bp, Homo sapiens
  Payload ID: 11387
  Gene Symbol: NUMA1
  Gene Name: nuclear mitotic apparatus protein 1
  ENST ID: ENST00000543009
  CDS Start-End: 353-874
ttttgttttcagccatgtaggagaagcagagtctacaagtccccgtgcctgcgtctgttaagggctgcagccagtgcctggcgtactcggtctcgtgccttggcccctcagcccctccccataaatgctcagcggaacaggggattaggttctggcagcacagctgggattttggcggccattccacagccgacaatagcacgcagcacaggacagcgcaggcctgtactccagggccagaatctgcctgggcttcttgtttgggtggcggagggggaggagcgggcacagcacggcatcctggccttgccacgcagaaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccag

SEQ ID NO: 160595 - DNA, 600 bp, Homo sapiens
  Payload ID: 11387
  Gene Symbol: NUMA1
  Gene Name: nuclear mitotic apparatus protein 1
  ENST ID: ENST00000544129
  CDS Start-End: 124-600
ggatgtgagtgtctctcagatggggagtatctttctaagaaaggggtacagagcatggaattcttaggctacaggcaggcagcgtctcagggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacc

SEQ ID NO: 160596 - DNA, 606 bp, Homo sapiens
  Payload ID: 11387
  Gene Symbol: NUMA1
  Gene Name: nuclear mitotic apparatus protein 1
  ENST ID: ENST00000535087
  CDS Start-End: 279-606
tcttcctgctctgccactgactcaccccgttgacctggcctgcatggcttcccttctgcttgctgtctgatccacagaacgctggggttgcccaggataatgtgaggctgagctcactaagagtgggtgggttaggggaatgaataatcattcctgtccctttgccccttccctaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagct

SEQ ID NO: 160597 - DNA, 911 bp, Homo sapiens
  Payload ID: 11387
  Gene Symbol: NUMA1
  Gene Name: nuclear mitotic apparatus protein 1
  ENST ID: ENST00000543937
  CDS Start-End: 309-911
aattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggagacaggttctcactatgttgcccacgctggtctcaaattccttggctcaagtgatcctcccatcttggcctccaaaagtgccgggattacaagcatgagcaactgtgcctggccctgaaaaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctcca

SEQ ID NO: 160598 - DNA, 3557 bp, Homo sapiens
  Payload ID: 11387
  Gene Symbol: NUMA1
  Gene Name: nuclear mitotic apparatus protein 1
  ENST ID: ENST00000541584
  CDS Start-End: 1-2894
cccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagacataaagcactcatgacaattatacctgatttgtcccccaacaaccctctgagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 160599 - DNA, 589 bp, Homo sapiens
  Payload ID: 11387
  Gene Symbol: NUMA1
  Gene Name: nuclear mitotic apparatus protein 1
  ENST ID: ENST00000541641
  CDS Start-End: 372-589
atagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggagctgtggcagaagcagtgtgaacaatgaatgcagaaatgctttgtatacatgaagacctatactgatgagaaagatagaggatgtagctgagatgtgctggagagagcactggatttagaagacatctctttgagttctggctctgcagccttaccagtcgaccttgaggcaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaa

SEQ ID NO: 160600 - DNA, 582 bp, Homo sapiens
  Payload ID: 11387
  Gene Symbol: NUMA1
  Gene Name: nuclear mitotic apparatus protein 1
  ENST ID: ENST00000535111
  CDS Start-End: 400-582
agccaggtaaccggcgcgggcccgcgtttggcgtgcggcctgggcacccctgcgggtgctcaggcctaaaaggggtgctggagaggccgctgcgagcggaaggcctcctccataaccgagtccgaaagggcagaatctatgggggtggaaactaattctaagccagactgctggagatcaccctgttctagtgtgtggaggcttccaccaggaggaaactgcagctgaggagccattgcagtcccatctccagaagacccccagaaagagttggaagagttcttcaggctgtggcagccactgcccaccaacacacccaaatcaatcaagatgaatcccaggtggtgaggctgaagcagatggtttggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactg

SEQ ID NO: 160601 - DNA, 280 bp, Homo sapiens
  Payload ID: 11387
  Gene Symbol: NUMA1
  Gene Name: nuclear mitotic apparatus protein 1
  ENST ID: ENST00000546131
  CDS Start-End: 112-280
gcgctcacagcgctggcgcgagcccacgaagaggtacgattccggagaatcgcgaggcagagcgggagcgcgcagccaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccgg

SEQ ID NO: 160602 - DNA, 792 bp, Homo sapiens
  Payload ID: 11387
  Gene Symbol: NUMA1
  Gene Name: nuclear mitotic apparatus protein 1
  ENST ID: ENST00000544238
  CDS Start-End: 131-792
gagagatggacagattattactgctgccttaaactctgggtggaaaacagagcgaagggggagtgtccggttgatcccagtttgtcaggcaggccactgcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaa

SEQ ID NO: 160603 - DNA, 2331 bp, Homo sapiens
  Payload ID: 11387
  Gene Symbol: NUMA1
  Gene Name: nuclear mitotic apparatus protein 1
  ENST ID: ENST00000537217
  CDS Start-End: 258-2331
cgggagcgcgcagccaggtaaccggcgcgggcccgcgtttggcgtgcggcctgggcacccctgcgggtgctcaggcctaaaaggggtgctggagaggccgctgcgagcggaaggcctcctccataaccgagtccgaaagggcagaatctatgggggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaa

SEQ ID NO: 160604 - DNA, 576 bp, Homo sapiens
  Payload ID: 11387
  Gene Symbol: NUMA1
  Gene Name: nuclear mitotic apparatus protein 1
  ENST ID: ENST00000535947
  CDS Start-End: 139-576
agatgtcagcatgtttttgttcagagaaggaaagcgtgtttgcctgcacgttgagctgtagagacagctcaggagagggcttcaccatttctgcgtgaggccgtgggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggac

SEQ ID NO: 160605 - DNA, 582 bp, Homo sapiens
  Payload ID: 11387
  Gene Symbol: NUMA1
  Gene Name: nuclear mitotic apparatus protein 1
  ENST ID: ENST00000535838
  CDS Start-End: 406-582
agtgactcttcctgctctgccactgactcaccccgttgacctggcctgcatggcttcccttctgcttgctgtctgatccacagaacgctggggttgcccaggataatgtgaggctgagctcactaagagtgggtgggttaggggaatgaataatcattcctgtccctttgccccttccctaggtggaaactaattctaagccagactgctggagatcaccctgttctagtgtgtggaggcttccaccaggagacaggttctcactatgttgcccacgctggtctcaaattccttggctcaagtgatcctcccatcttggcctccaaaagtgccgggattacaagcatgagcaactgtgcctggccctgaaaaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagag

SEQ ID NO: 160606 - DNA, 2766 bp, Homo sapiens
  Payload ID: 11387
  Gene Symbol: NUMA1
  Gene Name: nuclear mitotic apparatus protein 1
  ENST ID: ENST00000542977
  CDS Start-End: 212-2766
gcacttctggctgtcagccaggaagatcgctcctgccaggcagactgagaagaaaaccaacaacttttcttttgtgtgtggggttactttccactggcccccccttcctcctctcctttcaagatttaaatgctaatggcggattaaaacctgtagatacgtttggctttaggagtctggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggc

SEQ ID NO: 160607 - DNA, 2796 bp, Homo sapiens
  Payload ID: 11387
  Gene Symbol: NUMA1
  Gene Name: nuclear mitotic apparatus protein 1
  ENST ID: ENST00000545721
  CDS Start-End: 1-1060
agagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataacgaaaaacgggtattataccagatatctatttagggcacagttggaataaaaagcaagtggtcaagaaaggcttcgtggaagctatcgctcctgctgagtcttgaaagcatccataggtgtgtgtgccaggttgacgagaagagcagtgtgaacagaggctgtgaaagagcctgactaagctgagatgtgaggccaggaaggcccattggagaccgactattaagacttgatcctaaaggcattgaggaaaccttggtggctgtaattgaaaggtttaggagaaaaaaaaaggaaccttggaagaatttgaaactgaagagtacatggttaatttgcatcttaaaaagattattctaatagctagtatagaagttaagactggaaaaatgtttttattaaacacttacatttacttattttgtgctagacataaagcactcatgacaattatacctgatttgtcccccaacaaccctctgaggtaggtttattctgtctcctttaacagatgaatctggggcatagaggggcagtcacttgcccaaggttccccagtggtagagctggggtttgaccctgggcagcctggcctgagttcttggcttgtcaccactcatcttcctctgtcagtgccatgatgagtctaggtgagaggagatgaagcagaccagggaaaggacatgagcatggagtggggtgtggttaggagctgttcaggaagcttggtgattgggctcgccaagcaggacgacattggattatgcccacgttcatggcttgggggcctgagtggggggcgttcctattcactgaaatgggagatgcaggaggaagaacagagaagtgggcttagattgggacgtgtttgctgtgaagcagccatgggcatctggtggggatgggacatctgggtctgggcattgccactatgaggagctattaggagaagccaggggagtggactgaaaggaaggcccaggtcaagtgctttccttggtacctctgaaaaatcagagagatgggctgcttgacctcatctgcttgtagtaaggatgggaaatggtcactttcaaaaagggctggacaaaatgccttctagcgtgaaggactgtacctcagcaggtttcctttccatagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagc

SEQ ID NO: 160608 - DNA, 7012 bp, Homo sapiens
  Payload ID: 11387
  Gene Symbol: NUMA1
  Gene Name: nuclear mitotic apparatus protein 1
  Uniprot ID: Q14980
  ENST ID: ENST00000620566
  CDS Start-End: 45-6350
cttgggttccaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtg

SEQ ID NO: 160609 - DNA, 3940 bp, Homo sapiens
  Payload ID: 11387
  Gene Symbol: NUMA1
  Gene Name: nuclear mitotic apparatus protein 1
  Uniprot ID: Q14980
  ENST ID: ENST00000613205
  CDS Start-End: 339-3278
gccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtg

SEQ ID NO: 160610 - DNA, 6998 bp, Homo sapiens
  Payload ID: 11387
  Gene Symbol: NUMA1
  Gene Name: nuclear mitotic apparatus protein 1
  ENST ID: ENST00000616538
  CDS Start-End: 45-6344
cttgggttccaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagggctgcgcctgctgcaggcagagacagccagcaacagtgccagagctgcagaacgcagctctgctctgcgggaggaggtgcagagcctccgggagggagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctattttt

SEQ ID NO: 160611 - DNA, 7526 bp, Homo sapiens
  Payload ID: 11388
  Gene Symbol: NPAP1
  Gene Name: nuclear pore associated protein 1
  Uniprot ID: Q9NZP6
  ENST ID: ENST00000329468
  CDS Start-End: 1-3471
atgggcaatttacttagtaaatttagacccgggtgccgccgccggcccctgccagggccagggcgtggcgcccccgctcccctgtcccgggacgcctccccgcccggtcgggctcactctgtacccaccccgcgccctttccgcggcctgttccgccggaacgcccgtcgcaggccttcagcagccagcatcttcgtcgcccctaagaggccgtgtcctctccctcgggctgcggccgcccctctgggggtcctgccggctgtgggttgggggctggccatcaggaagacacccatgctgcctgctcggaaccccccgaggtttggacaccccagttccgtaaggatccctcctcccagccgcatgttcactctcctgctgccttcaccacgtgagccggcggtcaaggccaggaagcccatcccagccactctcctggaggagaccgaggtgtgggcccaagaagggcccagaagagtgaagaaggatgaggatccggtgcagatcgaaggggaggatgacgagaaaaggaccccccttagcagcggagaagcatcgtccacatccaggtcccagggcacccagggagacgtggcctccttcagatgcagccctgggcctctggagggaaatgtctaccacaagttctcagaaaacagcatgagtgagaaggcccaggcgtctccagcgagctcctgcttggaaggccctgccatgcccagcacacacagccaggccggatgtgcccggcatcttggaaagcctgatccggatgcaacagcgccccctgagccagccgttggctgctccctgctgcagcagaagttggctgcggaagtgctgaatgaagagccaccgcccagctccctaggcttgccgattccgctgatgtccggaaagaggatgcctgatgagaagcctttctgtattcctccaaggagcgctgctcctcccagagctgcccgcaacaggccctgcaaaaggaaaatgtcgattccattgctgctgccgctgcccccttcactgccattgctgtgggatcgaggtgagcttcccccacctgctaagctcccctgcctgtctgttgagggagacctacacaccttggagaagagccctgagtataaaaggaatagcagaatcttggaggataaaacagagaccatgacaaacagcagcatcacccagcctgccccttctttctcccaacctgtgcagaccacagactccctgcccctgaccacttacacttcccaggtctcagctcctttgcccatccctgacttggctgacctggctactggacccctcatcctgcctatccctccactttccaccacaccaaaaatggatgagaaaatagcattcacaatccctaactctcctctggctcttcctgctgaccttgttcccattttgggtgatcagtctaatgagaaaggaggctcttataattcagtcgtaggagcagcgcctctcacttctgaccccccaacacctcctagctccacaccctccttcaagcctcccgtcacaagggagtccccaatatctatgtgtgtggattcccctcctcctctttccttcctgactcttcttccagtcccttccaccgggacctcagttatcaccagcaagcctatgaattccacgtcagtcatttccactgtcacaacaaacgcatctgcccacctaacctcacagactgcggtagaccctgaagtagttaatatggatactactgccccatctcaggttgttattttcacatcttccctaagctccagagtgagctctctcccaaattcccaaatacattgcagtgcagagcagaggcacccgggaaagacatcagtctacacatccccacttccatttatattccacaataccaccccaagttttaaccaactctttggaaaagaagccacccctcagcccaaatttgaggctcctgatgggcagccgcagaaagcttctctccccagtgcctgtgttttcctgagccttcccatcattcctcctccagacacctccactttagtgaacagtgcctctacagcatcatcatccaaacctcccattgaaaccaatgctatgcataccactcctccttccaaggctgtcatcttgcagtctgcctctgtctccaagaagtacctcccattttacctggggcttcctggttctgggaacacacaacccagcggcaacactgcctcagtccaaggctccaccagtttgcctgcacagtcagtcagggcaccagctacagcttccaaccatcctttaaatccaggagccacccctcaacccaaatttggggcccctgatgggccgcagcagaaaacctctctccccagtgcccatgatttcctgagccttcctatcatggttcctccagacacctccactttagtgagcagtgcctctgcagcatcgttatccaagcctgccattgacaccagtgacatgaataccacccctccttccaaaactgtcatcttgcagtctacctttgtctccaggaaggaggagtacatccgattttatatggggcttcctggttctgggaacacactacacagtgacagcattgcctcagcccaagtctccaccagttttcctgcacaggcagataggagaccaaccacaacttccagccatcctttaaatacaggatccatctctcattccacacttggggccactgatgggcagcagaagtctgacagttcttttattctggggaatccagcaaccccagcaccagttataggcttaacatctccttcagtccagccactgagtggcagcataattccaccaggttttgcagagttaacatcaccatatactgcattgggcacacctgttaatgctgagccagtcgagggtcacaatgcaagtgctttccccaatggcacagcaaagacttctggatttagaattgccactgggatgcctggcactggagacagtaccttactggttggaaatactattccaggcccacaagtgattatgggacctggaacccctatggatggtgggagcattgggttcagcatgtctgccccaggccccagttccacatcaggagaactcaacattggacaaggacagagtgggacacccagcaccacttctgttttcccatttggtcaggcagcctgggacccaactggccacagcatggctgctgcaccacaaggggctagcaacattcctgtatttggatatacttctgctgccgcctacattcctggtttagacccacctacccagaattcatgcagtggtatgggaggggatggcaccagatccatagttggaggcccttgtgttcctgcttttcaacagtgcatcctgcagcacacatggacagagagaaaattctacacttcaagcacccactactatggacaagaaacatatgttaggagacatgtctgtttccaacttccgtaagagcacctgtggttcacctgatcacaccacatcagttgtggttgtaaataccagcattatccttttgtatggtcatgcttctagtttcatcttcatgccaagcacctgccatgtacctctccagaactcaggttgtgcaccaggaggggacaacaacatccctgtgctccctttctctgtcagtacacatgggtcccacctggacaaaacacaggtggtgcatctgcagtgaatggcaacatatctttaattagaggcccttgtgtatccacctaccaacaaagtacctagggcccacctggacaaaacacagatggtacctcttccaggagtgtcaacattcatttgatagaaggccctcatgtgcccatgtatcagcaaagcacctggggcccacctggacaaagcacaaaccatgcaatgagggacagcaacacaacggctgtgactggttgtacttttggtcccccatttacacaaagcacctgaggcccacctggctaaatgcaggtggtgcaataggagatagccccagatatttgtagggagaaacctctagtctccctttcagtaaaaatactatggacctgcccaaccaaggtgctccttttgactttagaggaaccagcattgtttttgttttggtttgtttgtttgtttgtttgtttgtttgtttgtttttgagacggagccttagcccaggctggagtgtagtagcacaatctcggctcactgcaacctccacctcctgggttcaagcaattctcctgtcttagcctcctgagtagctgggactacaggcatatgccaccacacctggctattttttataattttagcagagacagagttccaccttattggccaggctggtctcaaactcctgacctcaggtgatccacccacctcggcctcccaaagtgctaggatgacaggtgtgagccaccatgcccagcctagaggagccagcattgttagttaaatacttgtgtttggatggtcctggtcagagcacctgtgcctgtgatggaaagcagccactagtgacacttgtacctgccaaggccttcataggagccaccaactcattttttactcctatcaatggtcttaagaaataagcactctccctgcacatacagttctcataaattgacattgttccaggaggaatgggctcagttccctcaaggttaaacttaacctgctctcttcctacagaagctggaggcccaaaaccacagacagagagagagagagtgtgtgtgtttgtgtgtgtgtgtgtgtgtttattggtgagtgtggagcagatgagcccagtcagaaccgcactgtattttagtggtcttctgcactgtggagggtagaggaaacctggcttgactgttaacttggctgaccctacctctgggccagttctctctagtcatggacagaaaggcaaaattcccgactttgtggaccctatattctagttgaaggggagaaaagaagcaaaaacatggaaattatctggtaaattagccagtaacgaatgctatgaaaaataaagaagtacatggaggattgagattgtagatagaagcaggtgtttcagtttacactgtgaacaagcctcactgggaaggtaaatttaaacgaagcctagagagaagcagttgagccagatatatgagcaaagacctttccagataataggagtggtcattgcagaggctcaaaggaaggatccctggtgtcctcatggagcagttagtaaggaaatgtggctggaatggagtcagcaagtgggagggagggatagagaagaggacagaggagagatgtgagtggaattccttcctccactttttactaattgtgtaataacagttgactcaaacttcaaaagtctcaatgaaatcagtacttttactatggcctgtttatctcataagatttttgaaaggataaaatgaaataatatggagaaatgacttataagcttttgttgtaatttgttatatacatagggatggatagacggatggatagattagatgatagatagatagatagatagatgataacgttatggactgaatgtttgtgtacccccaaaaattgatattttgaagcctaacttccagtgtgatggtattaggaggtgaggctttggggaggtgattaggtttagatgaagtcatgaaaatgaaacccccatgatgggatttgcgcctttatgagaagaaataccagtgctttctctaattgccatgtgaaggtataccaacaaggtaacagtctgtaagccaggaaaagagtcctcacaagaaacagaatttgtctttatcttggacttcctaacctttagaattgtagaaaataattgaatgttgtttaagctaccagtctgtggcattttttgtagcaatcagaactgactaataaagatagatagatgatagatagatacatagatagatgatagagatagatgatagatagatagatagatagatagataatatacatatatatgtatggtcaatgactgagttccttaggcaatggtgccctgattgcctttattaggcaattcaaatagaagaatagaagaacccccttttttttttgagatggagtcttgctctgtcacccaggctggagtgcagtggcgtgatcttggctcactgcacgctccacctctcggaagaacccctttttattagcataaaagcacttacttttatgaagcaaacacatgtaaaaatatgataacagagactaaaacatttatgagattaggcctgaaagaaaacaatcacagagaaattactgaattcctcttggcaccctggggcctgattcattcgctctaaattgtttagtacagttccagaggatcaaagctcctgtttcctggccagataatcacctaacttttgtaatcagaactgcctttcagaagtagagtggaaatccagttttcttctaatagccctatacccttgcagtattaccagggacaaattttttaaaattcatacttcttgacattttttaaaaggcttcaagctaaatattatgatcctggtaagacaaactttgaataaatgtgtgagagatacaaagataatttttgttttcatgttttgatgcacttacacaactgaaactatttctaaatattcttttattttttattaagataaaaagcaaacataatatcaatttaaataatactgaaagtcaaccttcctaccacagttccctcctccagagatagtgtttagctactttgatgtcactcccatagttctgagtttgcttttttacttcaactattatgttatcttacagatgtcattgtttttcctaaaacttgaagtgccttcctttttttctccttgaactcttttcccataaaaaaaaaatgtttttggtttctagaattttcaaatagtattgtttacttgactgaatcccttccttttccagaaaccttgagcctcctccactggtttgggagtggtaagaccaaagtaaatgtaaaaagtaaagtagaggttcctcttcaaagactttcctccctatctaattagaaataagtagtaacttcttttagaagcaaaatgtattcacagacctgtactaacattcttaaatatctgctagtcataataaagaaatcaatgtactttatgttcttagctcccacaatttagcctaagtatttgccctggcatgcttatactggtccaagcattaggtcatagcctgttcctcttccttatttagaagtgtttttacctttctcagcattccacaagttacttcctcattcctttgttctcctctacctttgcctcttttaaaagttctaaattgctagccaatcgggacaaatacagaatgtgaggtcctgttccagccaatggaaaccggacacagcagtagggtggacgcgtcaggttataaatgaccctgtctcctttgttcggtgtactcttgtggcaaaactgctggcaagtgtaccctttctgcaggaagtaaaaatggccttactaaataaa

SEQ ID NO: 160612 - DNA, 1084 bp, Homo sapiens
  Payload ID: 11389
  Gene Symbol: NPIPA1
  Gene Name: nuclear pore complex interacting protein family, member A1
  Uniprot ID: Q9UND3
  ENST ID: ENST00000328085
  CDS Start-End: 1-1053
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaa

SEQ ID NO: 160613 - DNA, 657 bp, Homo sapiens
  Payload ID: 11389
  Gene Symbol: NPIPA1
  Gene Name: nuclear pore complex interacting protein family, member A1
  ENST ID: ENST00000424549
  CDS Start-End: 1-657
atgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcgg

SEQ ID NO: 160614 - DNA, 568 bp, Homo sapiens
  Payload ID: 11389
  Gene Symbol: NPIPA1
  Gene Name: nuclear pore complex interacting protein family, member A1
  ENST ID: ENST00000537062
  CDS Start-End: 1-557
aaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccgtatttgtaatagcaaatgggccctgactgtaaattag

SEQ ID NO: 160615 - DNA, 696 bp, Homo sapiens
  Payload ID: 11389
  Gene Symbol: NPIPA1
  Gene Name: nuclear pore complex interacting protein family, member A1
  ENST ID: ENST00000618714
  CDS Start-End: 1-696
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcc

SEQ ID NO: 160616 - DNA, 1127 bp, Homo sapiens
  Payload ID: 11389
  Gene Symbol: NPIPA1
  Gene Name: nuclear pore complex interacting protein family, member A1
  ENST ID: ENST00000634030
  CDS Start-End: 1-1110
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagcgtctgctctatccccttccaccctcagcggatgataatctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgttcactccccttccaccctcagctccaccctcagtggatgataatctcaagacacctcccgagtgtgtctgctcactccccttccaccctcagcggatgataatctcaagaaactaaggaagaataaataaata

SEQ ID NO: 160617 - DNA, 654 bp, Homo sapiens
  Payload ID: 11389
  Gene Symbol: NPIPA1
  Gene Name: nuclear pore complex interacting protein family, member A1
  ENST ID: ENST00000633354
  CDS Start-End: 1-654
cgggtgcggtggctgctcttttggctcctcttttggctcctgctgggatttatcagccatcagtccacctgtgtgagtagatgggtgctgtggctgctcttttggctcctgctgggatttatcagccatcagtccacctgtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcgg

SEQ ID NO: 160618 - DNA, 568 bp, Homo sapiens; identical to SEQ ID NO: 160614
  Payload ID: 11389
  Gene Symbol: NPIPA1
  Gene Name: nuclear pore complex interacting protein family, member A1
  ENST ID: ENST00000632782
  CDS Start-End: 1-557

SEQ ID NO: 160619 - DNA, 1110 bp, Homo sapiens
  Payload ID: 11390
  Gene Symbol: NPIPA2
  Gene Name: nuclear pore complex interacting protein family, member A2
  Uniprot ID: E9PIF3
  ENST ID: ENST00000529166
  CDS Start-End: 1-1110
atggtgaagctctctattgtcctgaccccacggttcctgtcccatgaccagggccagctcaccaaggagctgcagcagcacgtaaagtcagtgacatgcccatgcgagtacctgaggaaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcggagcatcgtcattcttcaggattgccctactggccctacctcacagctgaaactttaaaaaacaggatgggccaccagccacctcctccaactcaacaacattctataattgataactccctgagcctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagcggatgataatctcaagacacctcccaagtgtgtctgctcactccccttccaccctcagcggatgataatctcaagaaactaa

SEQ ID NO: 160620 - DNA, 954 bp, Homo sapiens
  Payload ID: 11390
  Gene Symbol: NPIPA2
  Gene Name: nuclear pore complex interacting protein family, member A2
  ENST ID: ENST00000530328
  CDS Start-End: 1-954
atggtgaagctctctattgtcctgaccccacggttcctgtcccatgaccagggccagctcaccaaggagctgcagcagcacgtaaagtcagtgacatgcccatgcgagtacctgaggaaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccgtatttgtaatagcaaatgggccctga

SEQ ID NO: 160621 - DNA, 1053 bp, Homo sapiens
  Payload ID: 11390
  Gene Symbol: NPIPA2
  Gene Name: nuclear pore complex interacting protein family, member A2
  ENST ID: ENST00000553201
  CDS Start-End: 1-1053
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcggagcatcgtcattcttcaggattgccctactggccctacctcacagctgaaactttaaaaaacaggatgggccaccagccacctcctccaactcaacaacattctataattgataactccctgagcctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagcggatgataatctcaagacacctcccaagtgtgtctgctcactccccttccaccctcagcggatgataatctcaagaaactaa

SEQ ID NO: 160622 - DNA, 954 bp, Homo sapiens; identical to SEQ ID NO: 160620
  Payload ID: 11391
  Gene Symbol: NPIPA3
  Gene Name: nuclear pore complex interacting protein family, member A3
  ENST ID: ENST00000526520
  CDS Start-End: 1-954

SEQ ID NO: 160623 - DNA, 1155 bp, Homo sapiens
  Payload ID: 11391
  Gene Symbol: NPIPA3
  Gene Name: nuclear pore complex interacting protein family, member A3
  ENST ID: ENST00000531598
  CDS Start-End: 1-1110
atggtgaagctctctattgtcctgaccccacggttcctgtcccatgaccagggccagctcaccaaggagctgcagcagcacgtaaagtcagtgacatgcccatgcgagtacctgaggaaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcggagcatcgtcattcttcaggattgccctactggccctacctcacagctgaaactttaaaaaacaggatgggccaccagccacctcctccaactcaacaacattctataattgataactccctgagcctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccaagtgtgtctgctcactccccttccaccctcagcggatgataatctcaagaaactaaggaagaataaataaataatataaaaataaaatgaatactgcagtc

SEQ ID NO: 160624 - DNA, 1053 bp, Homo sapiens
  Payload ID: 11391
  Gene Symbol: NPIPA3
  Gene Name: nuclear pore complex interacting protein family, member A3
  Uniprot ID: F8WFD2
  ENST ID: ENST00000552140
  CDS Start-End: 1-1053
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcggagcatcgtcattcttcaggattgccctactggccctacctcacagctgaaactttaaaaaacaggatgggccaccagccacctcctccaactcaacaacattctataattgataactccctgagcctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccaagtgtgtctgctcactccccttccaccctcagcggatgataatctcaagaaactaa

SEQ ID NO: 160625 - DNA, 1088 bp, Homo sapiens
  Payload ID: 11391
  Gene Symbol: NPIPA3
  Gene Name: nuclear pore complex interacting protein family, member A3
  ENST ID: ENST00000619019
  CDS Start-End: 1-1053
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcggagcatcgtcattcttcaggattgccctactggccctacctcacagctgaaactttaaaaaacaggatgggccaccagccacctcctccaactcaacaacattctataattgataactccctgagcctcaagacacctcccgagtgtctgctctatccccttccaccctcagcggatgataatctcaagacacctcccgagtgtctgctcactccccttccaccctcagctccaccctcagcggatgataatctcaagacacctcccgagtgtctgctcactccccttccaccctcagctccaccctcagcggatgataatctcaagacacctcccaagtgtgtctgctcactccccttccaccctcagcggatgataatctcaagaaactaaggaagaataaataaataatataaaaataaaatgaa

SEQ ID NO: 160626 - DNA, 1070 bp, Homo sapiens
  Payload ID: 11391
  Gene Symbol: NPIPA3
  Gene Name: nuclear pore complex interacting protein family, member A3
  ENST ID: ENST00000621766
  CDS Start-End: 1-1053
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcggagcatcgtcattcttcaggattgccctactggccctacctcacagctgaaactttaaaaaacaggatgggccaccagccacctcctccaactcaacaacattctataattgataactccctgagcctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagcggatgataatctcaagacacctcccaagtgtgtctgctcactccccttccaccctcagcggatgataatctcaagaaactaaggaagaataaataaata

SEQ ID NO: 160627 - DNA, 1053 bp, Homo sapiens; identical to SEQ ID NO: 160621
  Payload ID: 11391
  Gene Symbol: NPIPA3
  Gene Name: nuclear pore complex interacting protein family, member A3
  ENST ID: ENST00000610285
  CDS Start-End: 1-1053

SEQ ID NO: 160628 - DNA, 1155 bp, Homo sapiens
  Payload ID: 11391
  Gene Symbol: NPIPA3
  Gene Name: nuclear pore complex interacting protein family, member A3
  ENST ID: ENST00000631747
  CDS Start-End: 1-1110
atggtgaagctctctattgtcctgaccccacggttcctgtcccatgaccagggccagctcaccaaggagctgcagcagcacgtaaagtcagtgacatgcccatgcgagtacctgaggaaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatggagacaggtggaaaccaaagttcgagctaaaatctgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaacgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagcggagcatcgtcattcttcaggattgccctactggccctacctcacagctgaaactttaaaaaacaggatgggccaccagccacctcctccaactcaacaacattctataattgataactccctgagcctcaagacacctcccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagcggatgataatctcaagacacctcccaagtgtgtctgctcactccccttccaccctcagcggatgataatctcaagaaactaaggaagaataaataaataatataaaaataaaatgaatactgcagtc

SEQ ID NO: 160629 - DNA, 954 bp, Homo sapiens; identical to SEQ ID NO: 160620
  Payload ID: 11391
  Gene Symbol: NPIPA3
  Gene Name: nuclear pore complex interacting protein family, member A3
  ENST ID: ENST00000631716
  CDS Start-End: 1-954

SEQ ID NO: 160630 - DNA, 1088 bp, Homo sapiens
  Payload ID: 11392
  Gene Symbol: NPIPA5
  Gene Name: nuclear pore complex interacting protein family, member A5
  Uniprot ID: E9PKD4
  ENST ID: ENST00000360151
  CDS Start-End: 1-1053
atgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagcgtctgctctatccccttccaccctcagcggatgataatctcaagacacctcccgagtgtctgctcactccccttccaccctcagctctaccctcagcggatgataatctcaagacacctgccgagtgtctgctcactccccttccaccctcagctccaccctcagcggatgataatctcaagacacctcccgagtgtgtctgctcactccccttccaccctcagcggatgataatctcaagaaactaatgaagaataaataaataatataaaaataaaatgaa

SEQ ID NO: 160631 - DNA, 954 bp, Homo sapiens
  Payload ID: 11392
  Gene Symbol: NPIPA5
  Gene Name: nuclear pore complex interacting protein family, member A5
  ENST ID: ENST00000534094
  CDS Start-End: 1-954
atggtgaagctctctattgtcctgaccccacggttcctgtcccatgaccagggccagctcaccaaggagctgcagcagcacgtaaagtcagtgacatgcccatgcgagtacctgaggaaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccatatttgtaatagcaaatgggccctga

SEQ ID NO: 160632 - DNA, 699 bp, Homo sapiens; identical to SEQ ID NO: 103627
  Payload ID: 11392
  Gene Symbol: NPIPA5
  Gene Name: nuclear pore complex interacting protein family, member A5
  Uniprot ID: E9PKD4
  ENST ID: ENST00000543801
  CDS Start-End: 1-699

SEQ ID NO: 160633 - DNA, 1157 bp, Homo sapiens
  Payload ID: 11392
  Gene Symbol: NPIPA5
  Gene Name: nuclear pore complex interacting protein family, member A5
  ENST ID: ENST00000633044
  CDS Start-End: 70-1122
gttgatggacggatggctacatggatgtgatggagatggtttactatcgggaccttccgcatcctgctgatgttttgttgcttaggatatgaatggctgagcggaggctgtaaaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaactgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcgagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagcgtctgctctatccccttccaccctcagcggatgataatctcaagacacctcccgagtgtctgctcactccccttccaccctcagctctaccctcagcggatgataatctcaagacacctgccgagtgtctgctcactccccttccaccctcagctccaccctcagcggatgataatctcaagacacctcccgagtgtgtctgctcactccccttccaccctcagcggatgataatctcaagaaactaatgaagaataaataaataatataaaaataaaatgaa

SEQ ID NO: 160634 - DNA, 561 bp, Homo sapiens
  Payload ID: 11393
  Gene Symbol: NPIPA7
  Gene Name: nuclear pore complex interacting protein family, member A7
  ENST ID: ENST00000344087
  CDS Start-End: 1-170
gaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgct

SEQ ID NO: 160635 - DNA, 1331 bp, Homo sapiens
  Payload ID: 11393
  Gene Symbol: NPIPA7
  Gene Name: nuclear pore complex interacting protein family, member A7
  Uniprot ID: E9PJI5
  ENST ID: ENST00000530217
  CDS Start-End: 191-1300
tgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtacaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccatctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacagagaagaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 160636 - DNA, 1131 bp, Homo sapiens
  Payload ID: 11393
  Gene Symbol: NPIPA7
  Gene Name: nuclear pore complex interacting protein family, member A7
  Uniprot ID: E9PJI5
  ENST ID: ENST00000618131
  CDS Start-End: 1-1110
atgttttgttgcttaggatatgaatggctgagcggaggctgtacaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccatctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacagagaagaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatat

SEQ ID NO: 160637 - DNA, 1565 bp, Homo sapiens
  Payload ID: 11394
  Gene Symbol: NPIPA8
  Gene Name: nuclear pore complex interacting protein family, member A8
  Uniprot ID: P0DM63
  ENST ID: ENST00000525596
  CDS Start-End: 430-1539
cccgctgagcgtcgacacagtcgctgttggcctggtgtccagcgtggttgtctatcccgtctacctggccatcctctttctcttccggatgtcccggagcaaggtggctgggagcctgagccccacacctgccgggcagtaggtgctggacatcgacagctgcctggactcgtccgtgctggacagctccttcctcacgttctcaggcctccacgctgaggtgagggctctactgggggtcctgggctgggctgggggtcctgccgccttggcgcagcttggactccagacactgtgcacctctcagcaggcctttgctggacaggtgaagagtgacttgtttctggatgattctaagaggttgatggacggatggctacatggatgtgatggagatggtttactatcgggaccttccgcatcctgctgatgttttgttgcttaggatatgaatggctgagcggaggctgtacaacctggcactctgcttgggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccatctcaaaatggacatgatggatccacggatgtacagcagagagccaggaggtccaaccgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacagagaagaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaa

SEQ ID NO: 160638 - DNA, 1131 bp, Homo sapiens; identical to SEQ ID NO: 160636
  Payload ID: 11394
  Gene Symbol: NPIPA8
  Gene Name: nuclear pore complex interacting protein family, member A8
  Uniprot ID: P0DM63
  ENST ID: ENST00000541810
  CDS Start-End: 1-1110

SEQ ID NO: 160639 - DNA, 391 bp, Homo sapiens
  Payload ID: 11394
  Gene Symbol: NPIPA8
  Gene Name: nuclear pore complex interacting protein family, member A8
  ENST ID: ENST00000545050
  CDS Start-End: 1-391
gaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacagagaagaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaata

SEQ ID NO: 160640 - DNA, 3653 bp, Homo sapiens
  Payload ID: 11395
  Gene Symbol: NPIPB11
  Gene Name: nuclear pore complex interacting protein family, member B11
  Uniprot ID: E5RHQ5
  ENST ID: ENST00000524087
  CDS Start-End: 76-3561
tcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcacgtaaagtcagtgacatgcccatgcgagtacctgaggaaggttatcaatactctggctgaccatcatcatcgtgggactgactttggtggaagtccttggttacatattattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattgtataactgataactccctgagcctcaagacacctctcgagtgtctgctcactccccttccaccctcagcggatgataatctcaagacacctcccgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacaactgccgagcgtctgcgggggccgcttccaccctcagcggatgataatctcaagacaccttctgagcgtcagctcactccccttccaccctcagctccaccctcagcagatgataatatcaagacacctgccgagcatctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagccgatgataatctcaagacaccttctgagcgtcagctcactccccttccaccctcagctccaccctcagcagatgataatatcaagacacctgccgagcatctgcgggggccgcttccaccctcagcggatgataatctcaagacaccttctgagcgtcagctcactccccttccaccctcagctccaccctcagcagatgataatatcaagacaactgccgagcatctgcgggggccgcttccaccctcagcggatgataatctcaagacaccttccgagcgtcagctcactccccttccaccctcagctccaccctcagcagatgataatatcaagacacctgccgagcatctgcagttccgcttccaccctcagcggatgataatctcaagagaccttccgagcgtcagctcactccccttccaccctcagctccaccctcagcagatgataatatcaagatacctgctgagcatctgcgggttccgcttccaccgtcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacaccttccgagcgtcagctcactccccttccaccctcagctccaccctcagcagatgataatatcaagacacctgccgagcgtctgcgggggccgcttccaccctcagccgatgataatctcaagacaccttccgagcgtcagctcactccccttccaccctcagctccaccctcagcagatgataatatcaagacacctgccgagcgtctgcgggggccgcttccaccctcagccgatgataatctcaagacaccttccgagcgtcagctcactccccttccaccctcagctccaccctcagcagatgataatatcaagacacctgccgagcgtctgcgggggccgcttccaccctcagccgatgataatctcaagacaccttccgagcgtcagctcactccccttccaccctcagctccaccctcagcagatgataatatcaagacacctgccgagcgtctgcgggggccgcttccaccctcagccgatgataatctcaagacaccttccgagcgtcagctcactccccttccaccctcagctccaccctcagcagatgataatatcaagacacctgccgagcgtctgcggggagcgtctgtgggttccgcttccaccctcagcggatgataatctcaagacaccttccaaacgtcagctcactccccttccaccctcagctccaccctcagcagatgataatatcaagacacctgccgagcgtctgcgggggccgcttccaccctcagccgatgataatctcaagacaccttccaaacgtcagctcactccccttccaccctcagctccaccctcagcagatgataatatcaagacacctgccgagcgtctgcgggggccgcttccaccctcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaacctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggaggttgagctgagaagaggccagtgcactcaagcctgagcaataagaataaaaccgagtagaacaaaataaaaaattcaaaaaacaaaacaaaacccacactcc

SEQ ID NO: 160641 - DNA, 1216 bp, Homo sapiens
  Payload ID: 11395
  Gene Symbol: NPIPB11
  Gene Name: nuclear pore complex interacting protein family, member B11
  ENST ID: ENST00000614927
  CDS Start-End: 55-807
agccacctccacctctgtcctggacgcctcagggcgccctgaaaggaccaggacatgcgggggcggtggatgctcttttggctcctctttgggctcctgctggaatttatcagccatcagtgcatccgtgttatcaatactctggctgaccatcatcatcgtgggactgactttggtggaagtccttggttacatattattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctctt

SEQ ID NO: 160642 - DNA, 1428 bp, Homo sapiens
  Payload ID: 11396
  Gene Symbol: NPIPB15
  Gene Name: nuclear pore complex interacting protein family, member B15
  Uniprot ID: A6NHN6
  ENST ID: ENST00000429990
  CDS Start-End: 97-1428
atccggccccggtccccgtccccttccctcccccctgccctaagccacctccacctctgtcctggccgcctcagggcgccctgaaaggaccaggacatgcggctgcgcttttggctcctcatttggctcctgctgggatttatcagccatcagcccacccctgtcatcaatagtctggctgtctatcgtcatcgtgagactgactttggtgtaggagttcgagaccaccctggccaacatggcaaaaccccatctccacaaaaattggataatttgataattatcattattgggtttctgagacgtgacacatttaccattctcttctgcacaagttacctttgtgtgtctttcctgaagactatcttctggtctcgaaatggacatgatggatccacggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctgctggccctacctcacagctgaagctttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtatctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcgaaaaaaagaaaaaaatcaaaaaacaaaacaaaacccacgctccaaaaacaaactaa

SEQ ID NO: 160643 - DNA, 1216 bp, Homo sapiens
  Payload ID: 11397
  Gene Symbol: NPIPB3
  Gene Name: nuclear pore complex interacting protein family, member B3
  ENST ID: ENST00000448012
  CDS Start-End: 55-807
agccacctccacctctgtcctggccgcctcagggcgccctgaaaggaccaggacatgcgggtgcggtggatgctcttttggctcctctttgggctcctactggaatttatcagccatcagtgcatctctgttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctctt

SEQ ID NO: 160644 - DNA, 910 bp, Homo sapiens
  Payload ID: 11397
  Gene Symbol: NPIPB3
  Gene Name: nuclear pore complex interacting protein family, member B3
  ENST ID: ENST00000419180
  CDS Start-End: 157-910
gtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacatt

SEQ ID NO: 160645 - DNA, 679 bp, Homo sapiens
  Payload ID: 11397
  Gene Symbol: NPIPB3
  Gene Name: nuclear pore complex interacting protein family, member B3
  ENST ID: ENST00000521589
  CDS Start-End: 389-679
tgtcgcccagcctgaagtgcagtcgtgtgtttcatgcgcgtccgtgtgaagagaccaccaaacaggctttgtgtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaa

SEQ ID NO: 160646 - DNA, 490 bp, Homo sapiens
  Payload ID: 11397
  Gene Symbol: NPIPB3
  Gene Name: nuclear pore complex interacting protein family, member B3
  ENST ID: ENST00000534903
  CDS Start-End: 177-490
tttaaaggatgactgatggtccttggaagagaaacagtaaacaaataaggtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagca

SEQ ID NO: 160647 - DNA, 1342 bp, Homo sapiens
  Payload ID: 11397
  Gene Symbol: NPIPB3
  Gene Name: nuclear pore complex interacting protein family, member B3
  Uniprot ID: Q92617
  ENST ID: ENST00000542817
  CDS Start-End: 33-1295
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagt

SEQ ID NO: 160648 - DNA, 1254 bp, Homo sapiens
  Payload ID: 11397
  Gene Symbol: NPIPB3
  Gene Name: nuclear pore complex interacting protein family, member B3
  ENST ID: ENST00000504841
  CDS Start-End: 181-1254
ttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagct

SEQ ID NO: 160649 - DNA, 767 bp, Homo sapiens
  Payload ID: 11398
  Gene Symbol: NPIPB4
  Gene Name: nuclear pore complex interacting protein family, member B4
  ENST ID: ENST00000341400
  CDS Start-End: 280-767
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgac

SEQ ID NO: 160650 - DNA, 3606 bp, Homo sapiens
  Payload ID: 11398
  Gene Symbol: NPIPB4
  Gene Name: nuclear pore complex interacting protein family, member B4
  Uniprot ID: C9JG80
  ENST ID: ENST00000415645
  CDS Start-End: 41-3457
aggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataacatcaagacacctgccttccaccctcagcggatgataatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaatactgcagtcctt

SEQ ID NO: 160651 - DNA, 560 bp, Homo sapiens
  Payload ID: 11398
  Gene Symbol: NPIPB4
  Gene Name: nuclear pore complex interacting protein family, member B4
  ENST ID: ENST00000520808
  CDS Start-End: 130-279
aggtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatc

SEQ ID NO: 160652 - DNA, 576 bp, Homo sapiens
  Payload ID: 11398
  Gene Symbol: NPIPB4
  Gene Name: nuclear pore complex interacting protein family, member B4
  ENST ID: ENST00000518761
  CDS Start-End: 132-576
ataggtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatg

SEQ ID NO: 160653 - DNA, 519 bp, Homo sapiens
  Payload ID: 11398
  Gene Symbol: NPIPB4
  Gene Name: nuclear pore complex interacting protein family, member B4
  ENST ID: ENST00000529969
  CDS Start-End: 63-212
ttaaatgacttggatgttttataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggtatgaggttcttcctgccatcctgccatcatttgttttttatgttttgtcgccataagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttgg

SEQ ID NO: 160654 - DNA, 1342 bp, Homo sapiens
  Payload ID: 11398
  Gene Symbol: NPIPB4
  Gene Name: nuclear pore complex interacting protein family, member B4
  ENST ID: ENST00000537951
  CDS Start-End: 33-1295
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctcctcactccccttccaccctcagcggatgataaactcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagt

SEQ ID NO: 160655 - DNA, 513 bp, Homo sapiens
  Payload ID: 11398
  Gene Symbol: NPIPB4
  Gene Name: nuclear pore complex interacting protein family, member B4
  ENST ID: ENST00000536041
  CDS Start-End: 173-322
atgaattttaaaggatgactgatggtccctggaagagaaacagtaaacaaataaggtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaag

SEQ ID NO: 160656 - DNA, 513 bp, Homo sapiens
  Payload ID: 11398
  Gene Symbol: NPIPB4
  Gene Name: nuclear pore complex interacting protein family, member B4
  ENST ID: ENST00000543654
  CDS Start-End: 244-513
attagcttttaatcattgacttctagcacagttatatgatcagaaacatgctgtgtgatttgattgctctcaaatatattgagatttgctggaacaaaataagtcaggttaatttttgtaaatgtaccaggcatgcttaaaatgaatgtatctacatttgttcccgagatacaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggagg

SEQ ID NO: 160657 - DNA, 544 bp, Homo sapiens
  Payload ID: 11398
  Gene Symbol: NPIPB4
  Gene Name: nuclear pore complex interacting protein family, member B4
  ENST ID: ENST00000541674
  CDS Start-End: 458-544
tttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccctggaagagaaacagtaaacaaataaggtttcaggcacagaactgtatatccaataatagtgaaatggatcccactaattatgacagaaatgatgatacatttaaatgacttggatgttttataggttggcactcatcatgagcccctgttctcattctgcaaatggtgaagctctctattgtcctgaccccacagttcctgtcccatgaccagggccagctcaccaaggagctgcagcagcatgtaaag

SEQ ID NO: 160658 - DNA, 910 bp, Homo sapiens
  Payload ID: 11398
  Gene Symbol: NPIPB4
  Gene Name: nuclear pore complex interacting protein family, member B4
  ENST ID: ENST00000542133
  CDS Start-End: 62-184
gtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacatt

SEQ ID NO: 160659 - DNA, 400 bp, Homo sapiens
  Payload ID: 11398
  Gene Symbol: NPIPB4
  Gene Name: nuclear pore complex interacting protein family, member B4
  ENST ID: ENST00000544693
  CDS Start-End: 319-400
attacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaaggtttcaggcacagaactgtatatccaataatagtgaaatggatcccactaattatgacagaaatgatgatacatttaaatgacttggatgttttataggttggcactcatcatgagcccctgttctcattctgcaaatggtgaagctctctattgtcctgaccccacagttcctgtcccatgaccagggccagctcaccaaggagctgcagcagcatg

SEQ ID NO: 160660 - DNA, 1216 bp, Homo sapiens
  Payload ID: 11398
  Gene Symbol: NPIPB4
  Gene Name: nuclear pore complex interacting protein family, member B4
  ENST ID: ENST00000614197
  CDS Start-End: 55-807
agccacctccacctctgtcctggccgcctcagggcgccctgaaaggaccaggacatgcgggtgcggtggatgctcttttggctcctctttgggctcctactggaatttatcagccatcagtgcatctctgttatcaatactctggctgaccatcatcatcgtgggactgactttggtggaagtccttggttacatgtcattattgcatttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaaggaaataaaattgtcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaagtgacttcttgaggtgagattgttctgtcagaaaaccctctcccagttcccctgcagctctt

SEQ ID NO: 160661 - DNA, 1342 bp, Homo sapiens
  Payload ID: 11399
  Gene Symbol: NPIPB5
  Gene Name: nuclear pore complex interacting protein family, member B5
  ENST ID: ENST00000357370
  CDS Start-End: 33-1295
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagt

SEQ ID NO: 160662 - DNA, 3660 bp, Homo sapiens
  Payload ID: 11399
  Gene Symbol: NPIPB5
  Gene Name: nuclear pore complex interacting protein family, member B5
  ENST ID: ENST00000451409
  CDS Start-End: 280-3660
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctcttccaccctcagcggatgatctcaagacaccttccgagcgtcagctcactccccttccaccctcagctccaccctcagcagatgataatatcaagatacctggcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctga

SEQ ID NO: 160663 - DNA, 828 bp, Homo sapiens
  Payload ID: 11399
  Gene Symbol: NPIPB5
  Gene Name: nuclear pore complex interacting protein family, member B5
  ENST ID: ENST00000517347
  CDS Start-End: 43-192
ataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggtatgaggttcttcctgccatcctgccatcatttgttttttatgttttgtcgccataagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatga

SEQ ID NO: 160664 - DNA, 3797 bp, Homo sapiens
  Payload ID: 11399
  Gene Symbol: NPIPB5
  Gene Name: nuclear pore complex interacting protein family, member B5
  ENST ID: ENST00000521555
  CDS Start-End: 128-277
gtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataatataaaaataaaataaa

SEQ ID NO: 160665 - DNA, 3569 bp, Homo sapiens
  Payload ID: 11399
  Gene Symbol: NPIPB5
  Gene Name: nuclear pore complex interacting protein family, member B5
  Uniprot ID: A8MRT5
  ENST ID: ENST00000517539
  CDS Start-End: 76-3477
tcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactcc

SEQ ID NO: 160666 - DNA, 1906 bp, Homo sapiens
  Payload ID: 11399
  Gene Symbol: NPIPB5
  Gene Name: nuclear pore complex interacting protein family, member B5
  ENST ID: ENST00000528249
  CDS Start-End: 121-1906
tgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttcc

SEQ ID NO: 160667 - DNA, 543 bp, Homo sapiens
  Payload ID: 11399
  Gene Symbol: NPIPB5
  Gene Name: nuclear pore complex interacting protein family, member B5
  ENST ID: ENST00000542518
  CDS Start-End: 257-379
gaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacatgtcattattgcgttt

SEQ ID NO: 160668 - DNA, 551 bp, Homo sapiens
  Payload ID: 11399
  Gene Symbol: NPIPB5
  Gene Name: nuclear pore complex interacting protein family, member B5
  ENST ID: ENST00000356156
  CDS Start-End: 519-551
ctaatactcacagggaatatatagagtctagaagaaaatatacaggtccttaaaggctgccctgccaacaaaaccataacgcaggaacaaacatcacaactatgccaaataatcaatcctacaatgtccaaaattttactttaaaactggaattaccagacttcctttctgcattaaccagtttaactagacagtaacgaaatattcctactttatgctgtgatagtttgtttgtttgtttgtttgtttatttatttatttatttaagacagagtttcgctcttgttgcccaggctggagtgcagtggcacgatctcagctcaccacaacctccgcctcccaggttcaagcgattctcctgcctcagcctcccgagtagctgggattacaggtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacag

SEQ ID NO: 160669 - DNA, 513 bp, Homo sapiens
  Payload ID: 11399
  Gene Symbol: NPIPB5
  Gene Name: nuclear pore complex interacting protein family, member B5
  ENST ID: ENST00000545375
  CDS Start-End: 173-322
atgaattttaaaggatgactgatggtccttggaagagaaacagtaaacaaataaggtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttgggttatcaatactctggctgaccatcatcatcgtgggactgactttggtggaagtccttggttacatgtcattattgcgtttccgacaag

SEQ ID NO: 160670 - DNA, 3801 bp, Homo sapiens
  Payload ID: 11399
  Gene Symbol: NPIPB5
  Gene Name: nuclear pore complex interacting protein family, member B5
  Uniprot ID: A8MRT5
  ENST ID: ENST00000424340
  CDS Start-End: 280-3681
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctgagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtagaacaaaataaaaaattcaaaaaacaaaacaaaacccacactccaaaaactaacaaagaataaataaataat

SEQ ID NO: 160671 - DNA, 597 bp, Homo sapiens
  Payload ID: 11399
  Gene Symbol: NPIPB5
  Gene Name: nuclear pore complex interacting protein family, member B5
  ENST ID: ENST00000541154
  CDS Start-End: 363-597
actctcagaaggtgaacctaatttcaaatgaaagctgcctccagaatatattgttaagcgtattctagatataattcattttggcaaacatactgtagaaattcacataacattttactgtactaaaagtaaattgcccatgtaacaaaaaatatcttttcagagcttgaaatgaattttaaaggatgactgatggtccttggaagagaaacagtaaacaaataaggtttcaggcacagaactgtatatccaataatagtgaaatggatcccactaattatgacagaaatgatgatacatttaaatgacttggatgttttataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctgga

SEQ ID NO: 160672 - DNA, 910 bp, Homo sapiens; identical to SEQ ID NO: 160644
  Payload ID: 11399
  Gene Symbol: NPIPB5
  Gene Name: nuclear pore complex interacting protein family, member B5
  ENST ID: ENST00000541664
  CDS Start-End: 62-184

SEQ ID NO: 160673 - DNA, 711 bp, Homo sapiens
  Payload ID: 11399
  Gene Symbol: NPIPB5
  Gene Name: nuclear pore complex interacting protein family, member B5
  ENST ID: ENST00000543407
  CDS Start-End: 398-711
atgctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaagaaggagcaaaaagagcttgaaatgaattttaaaggatgactgatggtccttggaagagaaacagtaaacaaataaggtatgatctcgtgaaatcttgagagaaactgaatgacgaatgaaactattgttcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagca

SEQ ID NO: 160674 - DNA, 638 bp, Homo sapiens
  Payload ID: 11399
  Gene Symbol: NPIPB5
  Gene Name: nuclear pore complex interacting protein family, member B5
  ENST ID: ENST00000538606
  CDS Start-End: 280-638
tatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacacttttttttttaaattatctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtc

SEQ ID NO: 160675 - DNA, 543 bp, Homo sapiens
  Payload ID: 11399
  Gene Symbol: NPIPB5
  Gene Name: nuclear pore complex interacting protein family, member B5
  ENST ID: ENST00000536620
  CDS Start-End: 503-543
tgaaaatgaagatttggaaggagatcatcacagctaatgtttaacaagcccctcctgtgtgccaaatcattcacccctcaccacaaccgaatgagctaaggattctcattatatatagtttatggagagggaagtgcagacataaagaggtgaattatcttacccagatcacacagctgataagtggtggaggcagaatagaatctaaacagtgtggctccggagcccacatgcattgattcgacaagtgtttattgagcacctgccgcggacaaggccttgtgtgattaaatagggttataattagtaatataaaaatgagaaatcactaatgctttttagacttaacattttgtttttttgtaggtttcaggcacagaactgtatatccaataatagtgaaatggatcccactaattatgacagaaatgatgatacatttaaatgacttggatgttttataggttggcactcatcatgagcccctgttctcattctgcaaatggtgaagctctctattgtcctgaccccacagttcctgtc

SEQ ID NO: 160676 - DNA, 2268 bp, Homo sapiens
  Payload ID: 11399
  Gene Symbol: NPIPB5
  Gene Name: nuclear pore complex interacting protein family, member B5
  ENST ID: ENST00000415833
  CDS Start-End: 483-2268
gggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcgctattggacctctgagactttctactttaacagtttcacagtctttgccagttctaagtaccttgcagctgtattgctcgtctgctttggagaccacagtttctaacagactttcaacagaggactgtcttattccactcttcggcgaagctttacgttcatgtaaacagcatgacgtgaggccgtggatgcaggcattaaggtttcaggcacagaactgtatatccaataatagtgaaatggatcccactaattatgacagaaatgatgatacatttaaatgacttggatgttttataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctgctcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgctgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttcc

SEQ ID NO: 160677 - DNA, 516 bp, Homo sapiens
  Payload ID: 11399
  Gene Symbol: NPIPB5
  Gene Name: nuclear pore complex interacting protein family, member B5
  ENST ID: ENST00000544308
  CDS Start-End: 245-394
tttagacttaacattttgtttttttgtaggtttcaggcacagaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttgatggacggatggctacatggatgtgatggagatggtttactatcgggaccttccgcaccctgctgatgttttgttgcttaggatatgaatggctgagcggaggctgtaaaacctggcactctgcttggagacggggtttcaccatgtt

SEQ ID NO: 160678 - DNA, 696 bp, Homo sapiens
  Payload ID: 11399
  Gene Symbol: NPIPB5
  Gene Name: nuclear pore complex interacting protein family, member B5
  ENST ID: ENST00000539604
  CDS Start-End: 1-207
catgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaaggtttctcaccttctcctctcctcactctcaccaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaactaagcgtgaaagaatgtgagcatgcagaaaaggagaggcaggtatcagaggcagaggaaaatgggaaattggatatgaaagaaatacacacctacaagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccac

SEQ ID NO: 160679 - DNA, 1216 bp, Homo sapiens; identical to SEQ ID NO: 160643
  Payload ID: 11399
  Gene Symbol: NPIPB5
  Gene Name: nuclear pore complex interacting protein family, member B5
  ENST ID: ENST00000621622
  CDS Start-End: 55-807

SEQ ID NO: 160680 - DNA, 2016 bp, Homo sapiens
  Payload ID: 11400
  Gene Symbol: NPIPB6
  Gene Name: nuclear pore complex interacting protein family, member B6
  Uniprot ID: E9PJ23
  ENST ID: ENST00000532254
  CDS Start-End: 687-1964
tgtgccaaatcattcacccctcaccacaaccgaatgagctaaggattctcattatatatagtttatggagagggaagtgcagacataaagaggtgaattgtcttacccagatcacacagctgataagtggtggaggcagaatagaatctaaacagtgtggctccggagcccacatgcattgattcgacaagtgtttattgagcacctgccacggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacactatttttttaaattatctaataggttggcactcatgatgagcccctgttctcattctgcaaatggtgaagctctctattgtcctgaccccacagttcctgtcgcatgaccagagccagctcaccaaggagctgcagcagcatgtaaagtcagtgacatgcccatgcgagtacctgaggaaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggtggcagcggagcatcgtcattcttcaggattgccctactggccctacctcacagctgaaactttaaaaaacaggatgggccgccagccacctcctccaactcaacaacattctataactgataactccctgagcctcaagacacctactgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcaccgaaacccaagaggcggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctccaaaaa

SEQ ID NO: 160681 - DNA, 1329 bp, Homo sapiens
  Payload ID: 11400
  Gene Symbol: NPIPB6
  Gene Name: nuclear pore complex interacting protein family, member B6
  ENST ID: ENST00000533640
  CDS Start-End: 54-1277
gccacctccacctctgtcctggccgcctcagggcaccctgaaaggatcatgacatgcggctgcgcttttggctcctcatttggctcctgctgggatttatcagccatcagcccacccctgttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggtggcagcggagcatcgtcattcttcaggattgccctactggccctacctcacagctgaaactttaaaaaacaggatgggccgccagccacctcctccaactcaacaacattctataactgataactccctgagcctcaagacacctactgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcaccgaaacccaagaggcggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctccaaaaa

SEQ ID NO: 160682 - DNA, 1406 bp, Homo sapiens
  Payload ID: 11401
  Gene Symbol: NPIPB7
  Gene Name: nuclear pore complex interacting protein family, member B7
  Uniprot ID: O75200
  ENST ID: ENST00000452313
  CDS Start-End: 110-1354
cgccccaactcagatccggccccggtccccgtccccttccctcccccctgccctaagccacctccacctctgtcctggccgcctcagggcaccctgaaaggatcaggacatgcggctgcgcttttggctcctcatttggctcctgctgggatttatcagccatcagcccacccctgttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacgttctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcattgtcattcttcaggattgccctactggctctacctcacagctgaaactttaaaaaacaggatgggccgccagccacctcctccaactcaacaacattctataactgataactccctgagcctcaagacacctcccgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctccaaaaa

SEQ ID NO: 160683 - DNA, 1266 bp, Homo sapiens
  Payload ID: 11401
  Gene Symbol: NPIPB7
  Gene Name: nuclear pore complex interacting protein family, member B7
  ENST ID: ENST00000435324
  CDS Start-End: 1-1266
gtgaccttgaggaaccctgggagctcaggaaggaaggagcgcccagaagcagggacagggagctggttggggaggaccagaaatcaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacgttctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcattgtcattcttcaggattgccctactggctctacctcacagctgaaactttaaaaaacaggatgggccgccagccacctcctccaactcaacaacattctataactgataactccctgagcctcaagacacctcccgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtag

SEQ ID NO: 160684 - DNA, 508 bp, Homo sapiens
  Payload ID: 11402
  Gene Symbol: NPIPB8
  Gene Name: nuclear pore complex interacting protein family, member B8
  ENST ID: ENST00000526428
  CDS Start-End: 1-435
ctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtaagtttgtttgttttccttgcttttgaacatagtctgccaggtcaggacatggatacatttttctccctacagctctgtgctcaagccctgcagagggagatggcagagaggaaggctgcctacaggcatcacagtcccatccctgttggtaaccgtgttgtgcaaaaacaccttcatccccacccagtggggcccctgatctaaattcaaagtgtcagaggttccatatttgtaatagcaaatgggccctgactgtaaattagtgaagagtgaatgt

SEQ ID NO: 160685 - DNA, 2058 bp, Homo sapiens
  Payload ID: 11402
  Gene Symbol: NPIPB8
  Gene Name: nuclear pore complex interacting protein family, member B8
  Uniprot ID: E9PQR5
  ENST ID: ENST00000529716
  CDS Start-End: 708-2006
tgtgccaaatcattcacccgtcaccacaaccgaatgagctaaggattctcattatatatagtttatggagagggaagtgcagacataaagaggtgaattatcttacccagatcacacagctgataagtggtggaggcagaatagaatctaaacagtgtagaatctaaacagaatagaatctaaacatgcattgatttgacaagtgtttattgagcacctgccatgaacaaggccttgtgtgattaaatagggttataattagtaatataaaaatgagaaatcactaatgctttttagacttaacattttcttttttgtaggtttcaggcacagaactgtatatccaataatagtgaaatggatcccactaattatgacagaaatgatgatacatttaaatgacttggatgttttataggtatgatctcatgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccctatgctcttgaccactatagactcaaacatcaccttgtttttccactcattcaacaaactttttttcttaattgtctaataggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatagtctggctgtctatcgtcatcgtgagactgactttggtgtaggagttcgagaccaccctggccaacatggcaaaaccccatctccacaaaaattggataatttgataattatcattattgggtttctgagatgttacacatttaacattctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctccaaaaa

SEQ ID NO: 160686 - DNA, 2037 bp, Homo sapiens
  Payload ID: 11403
  Gene Symbol: NPIPB9
  Gene Name: nuclear pore complex interacting protein family, member B9
  ENST ID: ENST00000357796
  CDS Start-End: 1041-1985
tgtgccaaatcattcacccctcaccacaaccgaatgagctaaggattctcattatatatagtttatggagagggaagtgcagacataaagaggtgaattgtcttacccagatcacacagctgataagtggtggaggcagaatagaatctaaacagtgtggctccggagcccacatgcattgattcgacaagtgtttattgagcacctgccacggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacactttttttttaaattatctaataggttggcactcatgatgagcccctgttctcattctgcaaatggtgaagctctctattgtcctgaccccacagttcctgtcgcatgaccagagccagttcaccaaggagctgcagcagcatgtaaagtcagtgacatgcccatgcgagtacctgaggaaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctccaaaaa

SEQ ID NO: 160687 - DNA, 2123 bp, Homo sapiens
  Payload ID: 11403
  Gene Symbol: NPIPB9
  Gene Name: nuclear pore complex interacting protein family, member B9
  Uniprot ID: F8W1W9
  ENST ID: ENST00000550983
  CDS Start-End: 782-2071
tgtgccaaatcattcacccctcaccacaaccgaatgagctaaggattctcattatatatagtttatggagagggaagtgcagacataaagaggtgaattgtcttacccagatcacacagctgataagtggtggaggcagaatagaatctaaacagtgtggctccggagcccacatgcattgattcgacaagtgtttattgagcacctgccacggacaaggccttgtgtgattaaatagggttataattagtaatataaaaatgagaaatcactaatgctttttagacttaacattttctttttttgtaggtttcaggcacagaactgtatatccaataatagtgaaatggatcccactaattatgacagaaatgatgatacatttaaatgacttggatgttttataggtatgatctcgtgaaaccttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctgaagcccttgaccactatagactcaaacatcaccttgtttttccactcattcaacactttttttttaaattatctaataggttggcactcatgatgagcccctgttctcattctgcaaatggtgaagctctctattgtcctgaccccacagttcctgtcgcatgaccagagccagttcaccaaggagctgcagcagcatgtaaagtcagtgacatgcccatgcgagtacctgaggaagtgaccttgaggaaccctgggagctcaggaaggaaggagcgcccagaagcagggacagggagctggttggggaggaccagaaatcaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacattctcttctgcacaagttgcctttgtgtgtctttcctgaagactatcttctggtctcgaaatggacatgatggatccatggatgtacagcagagagcctggaggtccaaccgcagtagacagaaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagaaaatgtttcaacgtgcgcaagagttgcggcggcgggcagaggactaccacaaatgcaaaatccccccttctgcaagaaagcctctttgcaactgggtcagaatggcggcagcggagcatcgtcattcttcaggattgccctactggctctacctcacagctgaaactttaaaaaacaggatgggccgccagccacctcctccaactcaacaacattctataactgataactccctgagcctcaagacacctcctgagtgtctgctcactccccttccaccctcagtggatgataatatcaaggagtgtcctcttgctcctcttccaccctctcctcttccaccctcagtggatgataatctgaaggaatgtctctttgtcccgcttccaccctctcctcttccaccctcagtggatgataatctgaaggaatgtctctttgtcccgcttccaccctctcctcttccaccctcagtggatgataatctcaagactcctcccttagctactcaggaggccgaggtggaaaaaccacccaaacccaagaggtggagggtggatgaggtggaacaatcgcccaagcccaagaggcagagggaggccgaggcacaacaattacccaaacccaagaggcggaggttgagtaagctgagaacacgccattgcactcaagcctgggcaataagaataaatccgtaggtcgaaaaaaagaaaaaaatcaaaaaacaaaacaaaacccacgctccaaaaa

SEQ ID NO: 160688 - DNA, 1487 bp, Homo sapiens
  Payload ID: 11404
  Gene Symbol: NARF
  Gene Name: nuclear prelamin A recognition factor
  Uniprot ID: Q9UHQ1
  ENST ID: ENST00000345415
  CDS Start-End: 156-1382
tctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccg

SEQ ID NO: 160689 - DNA, 3949 bp, Homo sapiens
  Payload ID: 11404
  Gene Symbol: NARF
  Gene Name: nuclear prelamin A recognition factor
  Uniprot ID: Q9UHQ1
  ENST ID: ENST00000309794
  CDS Start-End: 199-1569
gtaagggtggggaatcctattggcccaggggtgcggcttgtcctctcccggtgctctcattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctcaatggattactttggtttctccgagttccctgctaccccgtttattggaggcccctcaggcagtttcatgtggtgctatcttcataataggtgtgggattggaactttttttttctttttttttttttgagacggagtctcactctgtcacccaggctggagtgcaatggcgcaatctcagctcactgcaacctctgcctcccgggttcaagcgattctcttgccccagcctcccgagtagctgggactaacgcgcacaccaccatgcccagctaatttttgtatttttagtagagatggggtttcactatgttggccaggctggtattgaattcctgacctcctgatccacccgccttggcctcccaaagtgccaggactgcaggcatgagccaccgtgcctggcagattggaacgttttaacatgagaggagcacttccccaatttatcccttcatcctaagattgtgaaaaagtcccaaagagtgggaatggagacagactactgtattttaggtttaaaaagaaaaatccagaaagtgtcctgtgaagagctaggacccccagaggttctaatgcacatgacttgaaggtgatttgatgtgggagtgagggcagagggtggggtggctgtgcctgtggactcctgtggccctggggttgttagggcaggcagtccacagtcccagatccctgcccattttggctctttcttttacccactcatattttccttgaaaatgtttttgccagaacattaataactgtcagccttttagaatcaggagacttacgtacaaatctggattttcagcttttcttagaaaaactgtagtttctgacaacagtaggccccattcctcacagccagtcaccaccctcctcccattcctcacagccagtcaccaccctcctggaccatactcggccctgggccattcctcacagccagtcaccaccctcctcccattcctcacagccagtcaccaccctcctggaccacactcggccctgggccattcctcacagccagtcaccaccctcctggaccatactcagggccctggaggcctggcaacccaggccccaactcaaacttgtacattcagtctttcagtcggactcgcactggggcaagggtgacagacacgagaatggaaaattgagaaggctgcccgcaccagctgggtgggtgcagggggccccagctcatcatcagcactgtcgtggggtgggagtcgggggtaaaggttccgtctgaccctgaggggttgaggatattcaggtggtccagcctcccgcagaagacttccctgtcacccttggcagacaggtttcttctcacacggccctggcccatccactcgccatgaagccctctgtgctcagggtgatggagccccctccattctggcactgcactgtgggcatgagcttgccttaaaaagaaaggagaggccaggcacggtggctcgtgccctataatcccagcacactgggaggccaaggtgggaggattgctggagtccaggagtttctacatgggagactctgtctctacaaattttttttttttttttgagacagagtctcactttgtcacccaggctggagttcagtggcgtgatctcggctcacagcaacctccgcctcctgggttcaagcgattctcctgcctcagcctctggagtagctgggattacaggcgcgcgccaccgcgcctggctaattgtattcttagttgagacgggtttcgccatgttgatcgggccggtcaggctggaatttctgacctcaggtgatccaaccacctcagcctcccaaaatgctgggattacaggcgtgagccactgcacctggcaaaaaatttttttttaaaaaggagaaagcagtttaaccacaaacagtgaaacagagctggcagacgcctgaaactccatggaaccatgcagctgtaccctagggctcctcccaggaaaagagagatgtcaacgtggcccaaggtgtcctgaagcactgggattggattaactcgagcgatggccttcccagccctccgtgctgcagagcctctgctcgctaggctgccttcatctcactctgtgtgctgtgcctgtgcacctgtcttgtcaataactgcatatattgtgttgcgttgcctgtcttgctggataactgcatatattgtgttcagttgtgtatttgttttgctttcagtctatatacagttgggtttccaacctctgattctggaataaacagttgcagcgtg

SEQ ID NO: 160690 - DNA, 1722 bp, Homo sapiens
  Payload ID: 11404
  Gene Symbol: NARF
  Gene Name: nuclear prelamin A recognition factor
  ENST ID: ENST00000374611
  CDS Start-End: 108-896
cgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgagagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgc

SEQ ID NO: 160691 - DNA, 1766 bp, Homo sapiens
  Payload ID: 11404
  Gene Symbol: NARF
  Gene Name: nuclear prelamin A recognition factor
  Uniprot ID: Q9UHQ1
  ENST ID: ENST00000390006
  CDS Start-End: 475-1668
tactccgccgagcctacgtgacacgacgtcaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaag

SEQ ID NO: 160692 - DNA, 1760 bp, Homo sapiens
  Payload ID: 11404
  Gene Symbol: NARF
  Gene Name: nuclear prelamin A recognition factor
  ENST ID: ENST00000412079
  CDS Start-End: 141-1652
attggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtaaggtacttatctcttggtggtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtagagggaggggctgccctgagtggagtattaaagacacttaagaaaaccgctc

SEQ ID NO: 160693 - DNA, 1668 bp, Homo sapiens
  Payload ID: 11404
  Gene Symbol: NARF
  Gene Name: nuclear prelamin A recognition factor
  ENST ID: ENST00000457415
  CDS Start-End: 102-1610
gggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcaggttcaggaggaaatgggctcagccttcccggttcttccaggaggctccactggctggggggctttgcagatgtttgggaggaccacacccagtcctgagggaggcagcagacagacatggatggagtgctggtgctcgaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggccttccagctgctcttggggccagagccaagagcctctcagtaga

SEQ ID NO: 160694 - DNA, 1454 bp, Homo sapiens
  Payload ID: 11404
  Gene Symbol: NARF
  Gene Name: nuclear prelamin A recognition factor
  ENST ID: ENST00000582907
  CDS Start-End: 79-645
gcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctgggatgctcccatttcccagtagcctccaggcctgcaggttcccatgacccacagccgggccaccgaggacgggttttgggtccagcacgagctcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctgg

SEQ ID NO: 160695 - DNA, 599 bp, Homo sapiens
  Payload ID: 11404
  Gene Symbol: NARF
  Gene Name: nuclear prelamin A recognition factor
  ENST ID: ENST00000579198
  CDS Start-End: 489-599
gctgctactccgccgagcctacgtgacacgacgtcaagtggcaatggcggcggacgagggctgtgcccccggcccgccccgttaggagccgcgagtaaggcgagtgtccaacgccgagctggctgacagagcccggccgcggcctccgcgggcccaggggcctccaggccccgtgaccaccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgtacgtggagaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtg

SEQ ID NO: 160696 - DNA, 1013 bp, Homo sapiens
  Payload ID: 11404
  Gene Symbol: NARF
  Gene Name: nuclear prelamin A recognition factor
  ENST ID: ENST00000581202
  CDS Start-End: 141-794
attggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgagagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtaagtggcttctctggggagagtcctctggggggca

SEQ ID NO: 160697 - DNA, 866 bp, Homo sapiens
  Payload ID: 11404
  Gene Symbol: NARF
  Gene Name: nuclear prelamin A recognition factor
  ENST ID: ENST00000577432
  CDS Start-End: 81-866
gggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggcc

SEQ ID NO: 160698 - DNA, 500 bp, Homo sapiens
  Payload ID: 11404
  Gene Symbol: NARF
  Gene Name: nuclear prelamin A recognition factor
  ENST ID: ENST00000584513
  CDS Start-End: 1-500
gaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggc

SEQ ID NO: 160699 - DNA, 1430 bp, Homo sapiens
  Payload ID: 11404
  Gene Symbol: NARF
  Gene Name: nuclear prelamin A recognition factor
  ENST ID: ENST00000581795
  CDS Start-End: 94-525
aacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttgggatgctcccatttcccagtagcctccaggcctgcaggttcccatgacccacagccgggccaccgaggacgggttttgggtccagcacgagctcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtaagtggcttctctggggagagtcctctggggggcaggacctctcgtcagccctgccagccacctgccaggcccagggctgccctgctttatgacgaggccatgtgaagcactgcgatgcagtcccccaggcccctgccacaaccctcagccaccctatagctgttgaatgggataccattcaccagggctgccagggagttgaaggtttggcgggcttccatggtgtgattgccaccctaaacccttgaggaaggacaaaatgcacaaacagctttgtcctcgctggcgcagggctgttcatgtgtgcaccagcccccttcttcctgagtgccgtctgtgcctcacattccgtgtggtctatggggcagtggggcagctccctcaggcccctttgcaccaagagtggcagtctgggttctgctgggggcggtgacctcgatacccagcaaggcccagggctcctgctgcaccccaggcactgggcagagagcaccacaaaggcagcagcgtgtgtcctcgccaacagtccgcatcccagg

SEQ ID NO: 160700 - DNA, 733 bp, Homo sapiens
  Payload ID: 11404
  Gene Symbol: NARF
  Gene Name: nuclear prelamin A recognition factor
  ENST ID: ENST00000580296
  CDS Start-End: 475-733
ccggaccgagcaccctggaacggccccagcttggcctcgggacagtccgcgcgctcaccgactccctggtgaacgccgcttggccgccgccgccgccgcaggacccacgagaagcggaaaccggcgcaaggacccggtccccccggcgccgccatggcaacaaccgcgcagcgcacgcaggggggttttgtagctgttattgccggaatgggctcctgtggatgctgctctgtggctggcacttctgcgcgtgacgccgtggcaggaggcttcctaacattccatgggtcgttcatccccggtggtggctgcgtcctattctaagaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctgg

SEQ ID NO: 160701 - DNA, 577 bp, Homo sapiens
  Payload ID: 11404
  Gene Symbol: NARF
  Gene Name: nuclear prelamin A recognition factor
  ENST ID: ENST00000580748
  CDS Start-End: 51-350
ggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagaggcaagtagatttttcagttttgtatcagcccagagtaaactactgctgctgtttttctctttgggggctcacagcaccgtgcacatcactgctttaaagaagactgaagtacgcgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaa

SEQ ID NO: 160702 - DNA, 873 bp, Homo sapiens
  Payload ID: 11404
  Gene Symbol: NARF
  Gene Name: nuclear prelamin A recognition factor
  ENST ID: ENST00000577410
  CDS Start-End: 400-873
gtggggctctgggcggccgaggttggcggtccgggcccgccgctcgctcgcttcagggctcttcaaggcgcccccggcctcggcaccctgggcccgctcggcgtggaggcggccggcgcggggtccgctgcgctctgcagggcgggttcggtcttcgcggttctccctgaacttgtccatctttcccacgcccgcgaagcgcggaaacgcacggagaccgagcctctcgtgccgcgcaccacagtccgagaatgtagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctcca

SEQ ID NO: 160703 - DNA, 525 bp, Homo sapiens
  Payload ID: 11404
  Gene Symbol: NARF
  Gene Name: nuclear prelamin A recognition factor
  ENST ID: ENST00000584411
  CDS Start-End: 263-525
aacaaagggccgcgggcggcgggcagtggtgtcccagtctcccggtgcttccctgaggctgaggcgcccggcctcccgcccgccgcgctccagatgaagtgtgagcactgcacgcgcaagtaagaaaacaaaaactgatgaccaagagaatgtgtcagccgatgcaccgagtccagcccaggaaaatggagagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagag

SEQ ID NO: 160704 - DNA, 891 bp, Homo sapiens
  Payload ID: 11404
  Gene Symbol: NARF
  Gene Name: nuclear prelamin A recognition factor
  ENST ID: ENST00000582585
  CDS Start-End: 107-406
gtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtagtaagaaaacaaaaactgatgaccaagagaatgtgtcagccgatgcaccgagtccagcccaggaaaatggagaggcaagtagatttttcagttttgtatcagcccagagtaaactactgctgctgtttttctctttgggggctcacagcaccgtgcacatcactgctttaaagaagactgaagtacgcgggcatggtggctcacgcctggaatcccagcactttgggaggccgaggtggacggatcacttgaggtcaggagtttgagaccagcctggccaacatggtgaaaccttatctctgctaaaaatacaaaaattatccaggtatggtggtgtacgcctgtaatcccagctactcaggaggctgaggcaggagaattgcttgaccctggaagacagaggttgcagtgagctgagattgtaccactgtacttcagcctgggcaacagagtgagactctgtcccaaaaaaaagactgaaataggccaggcgtggtggctcatgcctgtaatcccagaactttgggaggccgaggcaggcggatcatgagatcaggagattgagactatcctggctaacacagtgaaacctcatctctactaaaaatgcaaaaaattagccgggcgtggtggggggcgcctgtagtcccagctactcgggaggctgagccaggagaaaggcgtgaacctgggaggcggaacttgcatggctcactgtatggctcaccgcagccttgacctctgaggctca

SEQ ID NO: 160705 - DNA, 2112 bp, Homo sapiens
  Payload ID: 11405
  Gene Symbol: NARFL
  Gene Name: nuclear prelamin A recognition factor-like
  Uniprot ID: Q9H6Q4
  ENST ID: ENST00000251588
  CDS Start-End: 18-1448
gcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaacacgcctacgaaaa

SEQ ID NO: 160706 - DNA, 3212 bp, Homo sapiens
  Payload ID: 11405
  Gene Symbol: NARFL
  Gene Name: nuclear prelamin A recognition factor-like
  Uniprot ID: Q9H6Q4
  ENST ID: ENST00000540986
  CDS Start-End: 1437-2561
atcgggccgtctcaggtgggccggcctgggcgggcggggtcgaggctgcgctcggtgccctgtcgcgcggagggaaattgctctgcgccccacttcctcccctgaggaatgagatccgaatcccgggagcccggtctgggccgtcagggactctatcgacccgggcgcggggcctcagacactgaggcccgcttcttaccaacaaggaaactgaggccagggagggcggcgccccccaacccgctcctgtgccccatggtgtccgggcgggctgcgtgggagggtcccgtggtcgcgggctcgcgccggcctgcccaacccagaggaggcagcagaggcggctcccacacatccctaaccctaacccgacccctgggtcgcagctggagggcggcggggcccgggccggggcctcttccccttcccctgcgcaggacgccttgtcaggcctcaggacccccaagccacagcctttgcatctgcataaacgggtgcggtggggaccccacctcatttgagggcagtaggggcggcccgctagacgccccgcagtggctcctcagtagagctgtccttaacgtcgccctggtgggccggacagctacccttgaacccgggaggctgcaggcgcccttttctgggtgcacctgcctgtccatgtccaacagccccgcggggccagagctgagcagggcgagaggcgggctgctgggagcgcttccggcagggatgagctgggaggcggctttctgggctgccagggttctcaaggagaagagagagaaatccacttgtttcccgggcactgagcaggaggtggtctccaaacagatccaagcacacgtcctctcgatgggcagtgcaactctggtctctgtggtggtcacgccccctgttcacgtgaagggtgaaggtcagtgttggtggtgtctccgcaggtgggtagtttgcaggcgctgttagcactggccttcctgcacactgggaacttcagtgccgcaggatgttgggaacccgatccctgggtgagagcagtggggcaggaagaagacggtgggaccagcctcagtccctgagtgcatggctcctggcagagccttcaggctgtgcggctgggcagccatccttgaggcctggcctcccagggaacctccgcccactcacaggggctgatttggggtctcttcctgctctaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaac

SEQ ID NO: 160707 - DNA, 546 bp, Homo sapiens
  Payload ID: 11405
  Gene Symbol: NARFL
  Gene Name: nuclear prelamin A recognition factor-like
  ENST ID: ENST00000570289
  CDS Start-End: 4-252
gtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagtaaggcacaggaggctgctccaccatctctcctgcccggctgatccgaaacacttttctctgcttcctcccgtcacagagcggtgaccccgagacactccaggacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaatagg

SEQ ID NO: 160708 - DNA, 634 bp, Homo sapiens
  Payload ID: 11405
  Gene Symbol: NARFL
  Gene Name: nuclear prelamin A recognition factor-like
  ENST ID: ENST00000565065
  CDS Start-End: 13-225
agtgcggccgtcatggcgtcgcccttcagcggggcgctgcagctgacggacctggatgacttcatcgggccgtctcagatccaagcacacgtcctctcgatgggcagtgcaactctggtctctgtggtggtcacgccccctgttcacgtgaagggtgaaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcaga

SEQ ID NO: 160709 - DNA, 1918 bp, Homo sapiens
  Payload ID: 11405
  Gene Symbol: NARFL
  Gene Name: nuclear prelamin A recognition factor-like
  ENST ID: ENST00000565425
  CDS Start-End: 13-579
agtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaaggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggc

SEQ ID NO: 160710 - DNA, 961 bp, Homo sapiens
  Payload ID: 11405
  Gene Symbol: NARFL
  Gene Name: nuclear prelamin A recognition factor-like
  ENST ID: ENST00000562421
  CDS Start-End: 403-961
tcttcctgtgccttcgtcctttcctcctttgtcctcagctttcccgcctcctcctttcagagcccaccttcggcattttcctgccctacagccctgtgagtgtgcaccggggccagcaccccgtccagggccccatgggtgagtggggtggctgctgctttgctgagataccagtggcaagccttagtcctgtgattcggatgcactaaccaagtggtaccaagaagcagacttgacggcattatgaaactgtagagcgacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctcc

SEQ ID NO: 160711 - DNA, 568 bp, Homo sapiens
  Payload ID: 11405
  Gene Symbol: NARFL
  Gene Name: nuclear prelamin A recognition factor-like
  ENST ID: ENST00000567403
  CDS Start-End: 237-568
tcctgtgccttcgtcctttcctcctttgtcctcagctttcccgcctcctcctttcagagcccaccttcggcattttcctgccctacagccctgacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccg

SEQ ID NO: 160712 - DNA, 2486 bp, Homo sapiens
  Payload ID: 11405
  Gene Symbol: NARFL
  Gene Name: nuclear prelamin A recognition factor-like
  Uniprot ID: Q9H6Q4
  ENST ID: ENST00000568545
  CDS Start-End: 705-1829
gaaaagttgctgaggcatgtcccggaggcccccgactggaacaccttgttcctgcatctgtttggcgagtctgacggttgtttctgccccgcccaccggaggccaggctcccaggcttcctccctctgctctcctcttcctgtgccttcgtcctttcctcctttgtcctcagctttcccgcctcctcctttcagagcccaccttcggcattttcctgccctacagccctgtgagtgtgcaccggggccagcaccccgtccagggccccatgggtgagtggggtggctgctgctttgctgagataccagtggcaagccttagtcctgtgattcggatgcactaaccaagtggtaccaagaagcagacttgacggcattatgaaactgtagagcgtgcgtgtgcatttttgtaatacatacctaatttttaaaaattcagcggcacacaagcccagccagcagccatgttggttgtcggttatgagctggactccactatcctctgtctccatgtcctcgtgcagagggggcccctgtgcaccgggttcttctcccttgtaggacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggctggatctgctatgccgagaagactcacggcagcttcatcctcccccacatcagcaccgcccggtccccgcagcaggtcatgggctccctggtcaaggacttcttcgcccagcagcagcacttgacccctgacaagatctaccacgtcacagtgatgccctgctatgacaaaaagctggaagcctccagacccgactttttcaaccaggagcaccagacacgggatgtggactgtgtcctcacaacaggagaagttttcaggttgctggaggaagagggcgtctccctccccgacctggaaccagcccctctggacagcctgtgcagcggtgcctctgcagaggagcccaccagccatcggggagggggctcggggggctacctggagcacgtgttccggcacgcggcccgagagctctttggaatccatgtggctgaggttacctacaaacccctgaggaacaaagacttccaggaggtgacactggagaaggagggccaggtgctgctgcacttcgcaatggcgtacggcttccgcaacatccagaacctggtgcagaggctcaaacgagggcgctgcccctaccactacgtggaggtcatggcctgcccctcaggctgcctgaacggcgggggccagctccaggccccagacaggcccagcagagagctcctccagcacgtggagagactgtacggcatggtccgggctgaggcgcccgaggacgcgcctggggttcaggagctgtacacacactggctgcagggcacggactcggagtgtgcaggtcgcttgctgcatacgcagtaccacgccgtggagaaggccagcactggcctgggcatccggtggtaggggctgcaggaccaggactcccaggaggccgtgtccatgtgtgacagcagaaccacatgccccaagaccccagggcttcccccaaaattctgagtgagctgcagggtgtgctgggacccgagtaggagctaggactagccaggacccgcagccgcctcgtcacctccagttgggtgcctctgggttcccactggctctgcccaggtggggtggggtggcccaggcagcagaaggttccctgaggtcccagagcctgttccgttggccctgggccgaggcccacaggtgctgcccttgctgctgctggtcgggcacccaagtgcgtgaggggcttcagcctgtcccggggttgcctgaggcagagcaagacgggttctcacccctgacttctggaggcttcccttgaagctctgtgcaaaaggtgggagacagagctggacctgcaggggtggtcccgccacaaccctgcgtgtggaccctggcaggggggggtgccaggcccctggaaagcaggggttaccgttacgaggctgtggtccggggcaagccaagtacgaagcagcagccatcgcgggctgcatcatcccccagccaggtccccaccaggcctgtctcccagcgtttgtctaataaacgcacccctcctaaaacacgcct

SEQ ID NO: 160713 - DNA, 565 bp, Homo sapiens
  Payload ID: 11405
  Gene Symbol: NARFL
  Gene Name: nuclear prelamin A recognition factor-like
  ENST ID: ENST00000570066
  CDS Start-End: 31-231
acacctgcgcgcggcggcagtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaaagcccaccttcggcattttcctgccctacagccctgtgagtgtgcaccggggccagcaccccgtccagggccccatgggtgagtggggtggctgctgctttgctgagataccagtggcaagccttagtcctgtgattcggatgcactaaccaagtggtaccaagaagcagacttgacggcattatgaaactgtagagcgacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttg

SEQ ID NO: 160714 - DNA, 561 bp, Homo sapiens
  Payload ID: 11405
  Gene Symbol: NARFL
  Gene Name: nuclear prelamin A recognition factor-like
  ENST ID: ENST00000566614
  CDS Start-End: 402-561
aggtacgcagaggatgaggaaatggacggagccagatcccctccgcttccttgtgaaggcggagagactccggggccggagctgcggcgctggcccgaccaacccctgcgccccctgcaccccaacccggggcctggggcgcgcgggaggtggacgaagcggagtgcatcaagcctgtcaaagtggaaaaaagggcgggaagtggcgtggccaagattcgcattgaagatgacgggagctacttccaaattaaccaagacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaatcctacagatactgccaggaaattaacctcattctttaaaaaaataggggtgcacttcgtcttcgacaccgcct

SEQ ID NO: 160715 - DNA, 6117 bp, Homo sapiens
  Payload ID: 11406
  Gene Symbol: NPAT
  Gene Name: nuclear protein, ataxia-telangiectasia locus
  Uniprot ID: Q14207
  ENST ID: ENST00000278612
  CDS Start-End: 107-4390
gttcagtgccgccactggaaccaggagatgcggcgcaggagctgtcgctgtgtttgctttaacctgagtcttgttccttattgtggttcctgctgtggttttgatcatgttgttaccctcggacgtagcccggcttgtattgggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagagcccgaacgagaactggaattgcagaaatcaaacggcagagaaagcttgcatctcaaacagctccagccagtgcagagttgctcactttaccttacctttcaggacagtttaccactcctccttccacaggtacacaggttactcgaccaagtggccaaatttcagatccatcgaggtcatattttgtagtggtcaaccactcacagtcacaagatactgtaaccactggagaagctttaaatgtcattcctggtgctcaggaaaagaaagcacatgccagtttaatgtctcccggtagacgcaaaagtgaatctcagagaaaaagtaccactttgtctggccctcattcaacaatacggaatttccaagatccaaacgcttttgcagtagaaaaacaaatggttattgaaaatgcacgagaaaaaatactaagcaacaaatctcttcaagaaaagctagcagaaaacataaataaatttttaactagtgataacaatattgcccaagtacctaagcaaacagataacaaccctacggagccagagacttcaattgatgaattcctaggacttccgagtgaaattcacatgtctgaagaagctatacaggacatattggaacagacagaatcagacccagcatttcaggcactctttgatctctttgactatggcaaaacaaagaataataaaaatatatcacaaagtatttccagtcaacctatggaatccaatcccagtatagtcttagcagatgaaactaatctagcagttaaaggttcttttgaaacagaagaatctgatggtcagtctggtcagcccgctttttgtacatcctatcagaatgatgacccattaaatgctttgaagaatagcaacaaccatgatgtgcttagacaagaagaccaggaaaatttttcccaaataagtaccagcatacagaaaaaggcctttaaaacagctgtacccactgaacagaagtgtgacattgacattacctttgagtccgtgcctaatttgaatgactttaaccaaagagggaattctaatgctgaatgtaatccacattgtgctgaattatacaccaatcagatgtccactgaaactgaaatggctatagggattgaaaagaactctttgtcttcaaatgtaccgagtgaatctcagttacagcctgatcagcctgatataccaataacttcatttgtttcacttggttgtgaagctaacaatgaaaacttaattctctctgggaagagttctcaacttttatcccaagatacttcattaactggaaagccatctaaaaaaagtcaattttgtgaaaattctaatgatacagtaaaacttaaaattaattttcatggttccaagtcatcagattctagtgaagttcacaagagtaaaatagaaattaatgtgttagaaccagttatgtcacagctatcaaattgccaagataattcttgtcttcaaagtgaaatactacctgtgtctgttgaaagttcacatttaaatgtatctggacaagtagaaattcatcttggagattcgctgtcttctactaaacaaccatctaatgattcagcatctgttgagttaaatcatacagaaaatgaagctcaggcatccaagtctgagaattcacaggagccttcatcttctgtaaaagaagagaatactatttttctctctttaggtggaaatgctaactgtgagaaagttgcactgacgcctccagaaggcactcctgtagaaaacagtcactctcttcctccagaatctgtgtgttcttcagtgggagattctcaccctgagtcccaaaatactgatgataaaccttctagcaacaactcagcagagatagatgcatcaaatatcgtctctctcaaagttatcattagtgatgatccatttgtttcctcagatactgaacttaccagtgctgtttctagtattaatggagaaaacctgccaactataatcttgtcttctcctactaaatcacctactaaaaatgcagaactagttaaatgcctatcttcagaagaaactgtaggtgctgttgtatatgccgaagtaggggattcagcctcaatggaacagagtcttttaacattcaaatctgaagactctgcagtaaacaatactcagaatgaagatggcattgctttttcagctaatgttacaccatgtgtttccaaggatggaggatatatacagttgatgccagccacaagcacagcttttggcaattcaaataacattctgatagctacctgtgtgactgatccaacagcgttaggaacatctgtaagtcagtctaatgtagtggtgttgcctggaaattctgcacctatgactgctcaacctctaccacctcagttacagacaccaccaaggtcaaacagtgtatttgctgtcaaccaagctgtgtcaccaaacttttcacaaggatctgccataataattgcctctccagtccagcctgtactccaaggaatggtagggatgatcccagtatctgtggttggacagaatggaaataacttttctactcctcctcggcaggttcttcatatgcctttgacagcacctgtatgcaatagaagtatccctcaattccccgtccctccaaaatctcagaaggctcagggactaagaaacaagccttgtataggaaaacaagtaaataatttggtggattcgtcaggtcattcagttggatgtcatgcacaaaaaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtacatcaaaagtaatggtccctcctgtcaccccagacttgcctgcctgcagccctgccagtgaaacaggaagtgaaaacagtgtaaatatggctgcccacacattaatgattctctccagggcagccatttctaggactacttcagcaactcctctgaaagataacacacaacagtttagagcatcttcaaggagcaccacaaaaaagcggaaaattgaggaattagatgaacgtgagcgaaactctcgtccttctagtaaaaatcttacaaattcatcaataccaatgaaaaagaagaaaattaagaaaaagaagcttcccagttcatttccagcaggaatggatgtagacaaatttttgttatcattgcattatgatgagtaaacattctggacacataagaacagtaggtgttaaaaactcatatcccttaaactgagtgtagggaatgggatattgacagaatctgaaagcatgacctgcactttcattgtactgaaacttcactttatatctaaatcatgctgtttctgaaacagcttcctagtttgtaaatagacttacttggtatatttttattttgggaaaaacgtttgcagaaatgtaagtaaagccaatctgcaaaactgtatagctttgacaattccatattgtaaatactgtgtaaatcttgttgaaatagaggttaaatcaacctaatgttcttacactgtgttttttgacttcttatgatccctaattctgagacttactcatctggaatagtttctcacttgttttggaggaaaatgatgcttattcttataaattaccttcagtaactattcaataagacatttaaatacacaatcactaagtactacaaaataataaccacctcaactgatagcaaaatatctaattagaaatcaacagtttgatgagtttttttcctagagtgaatactacccctttcttataattgctgtaagtattatatttctggaatttcacactttacctactctgatcactctgttctctttgttttaaagagagaattttgtaaaccatttattgaatgttctgatctttcatttataacttaagattttttacagaactttaagtggttagactattgagccataaaattttggtttgtagtagagatttctcggtatgtacttttcccctaaatgctggggatttaaagaattgcactaattcatagaactctttacattgtagtgaccaatgcacatataatttaaatcttgtgttctatgtgagagtttatgtggaggattatcttctggtgttgtgtccatcataagatgtaaaaagagaaatcatagttttatattttagtttctcctacaatgggtatgttaaataactatatctatacttagatatagtgcattgtctgtgtcccttaaagtgttacaaagagtttctctcaaaaggtccttaaggagagtgagagatgagagaggtgccttctctgtattagactcacacacatcagtccagttgaagaattggtttaaacttttaaatgagaacagaaattataattagtacctgaccaattgtgcctagatattaaagtatgttctctttagtactttccgttcaattaaatatcagtatattagggatttttttctacaggtgtatattttgttgaagagtcactttcctcaaccatttttttgtactgggcctttaaaaaaataaatccatccaactttaacacaacatttctcagtgtagaaatcatgtcttcttaattgctgaaccttactgcaaaaacttgtgatgtaagaaatttgtatggtgtggcagtggtctattcctaaggaactaaatatcatatagttaatgtttatttaactcagcttgagactgtactacagttaggtttgaataaatattttcattaacttcaaaagtttgaattactttacattggcagtcttgtttagaaactgattaaattcctttgcaagtcagttctttttgggagtttgtacaatgctgaaaatcacagttttcttcttattcaattcatagttgtatgtactaagcactgaaaattcatatacaaataaaataagtttactttc

SEQ ID NO: 160716 - DNA, 575 bp, Homo sapiens
  Payload ID: 11406
  Gene Symbol: NPAT
  Gene Name: nuclear protein, ataxia-telangiectasia locus
  ENST ID: ENST00000531384
  CDS Start-End: 81-263
gatgcggcgcaggagctgtcgctgtgtttgctttaacctgagtcttgttccttattgtggttcctgctgtggttttgatcatgttgttaccctcggacgtagcccggcttgtattggacagggtctcaccctgttgcccaggctcgagtgcagtggtgcagtcatggttcgctgcagcctcgacctcctgggctcaagctatcctcccacctccacctccagagcagctggaactacaggtgcacaccaccaagcccagctaatttctaaaaaccatagaggttacttacagcaagaaaacctcatttctacctgccagacttttattttggaaagttcagatttaaaagaatatgcagaacattgtacagatgaagggtttattccagcctgcttactgtccttatttggaaaaaacttgacaacaattttaaatgagtatgtagctatgaaaacaaaagaaacatcaaataatgtcccagcaataatgtcatctctatggaagaaattggaccatacactttctcagatcaggagcatgcaaagttccccaaggtttgctggcagtcagagag

SEQ ID NO: 160717 - DNA, 898 bp, Homo sapiens
  Payload ID: 11406
  Gene Symbol: NPAT
  Gene Name: nuclear protein, ataxia-telangiectasia locus
  ENST ID: ENST00000527296
  CDS Start-End: 1-898
atttggtggattcgtcaggtcattcagttggatgtcatgcacaaaattttgttttgttttgttttagaactgaagtttctgacaaaagtattgccacagatcttgggaaaaaatcagaagaaaccacagttcccttcccagaagagagtatagttccagctgctaaaccatgccacagacgtgtactctgtttcgacagcactactgctcctgtggcaaatacgcaggggccaaaccataagatggtgtcccaaaacaaagaaaggaatgcagtctcttttcctaatcttgactcacccaatgtgtcctccaccttaaaacccccttctaataatgctatcaaaagagagaaagagaagcctcctctgcctaagattttatctaaatcggaaagtgccattagccggcataccaccataagagaaactcaatcagaaaagaaagtttcaccaacagaaattgtgcttgaatctttccataaagcaacagctaataaggagaatgaattatgcagcgatgtagaaagacagaaaaatccagaaaattcaaaactatctattgggcagcaaaatgggggtttgcgaagtgagaaatctatagcttcactgcaagaaatgaccaaaaaacaaggcacatcttcaaacaataaaaatgtactttcagtaggtacagctgtgaaggatctaaaacaagaacaaactaaatccgccagttctttgattaccacagaaatgttacaggatatacagaggcacagctcagtaagtaggcttgctgatagtagtgatttacctgtgccccggacacctggctcaggggcaggggaaaaacataaagaagaacctatagatattatcaaggccccctctagtaggcgtttcagtgaagacagtagtac

SEQ ID NO: 160718 - DNA, 5491 bp, Homo sapiens
  Payload ID: 11407
  Gene Symbol: NUPR1
  Gene Name: nuclear protein, transcriptional regulator, 1
  Uniprot ID: O60356
  ENST ID: ENST00000324873
  CDS Start-End: 268-516
ccagctgggtgagcctgggagggaggaggtgagttgggctggactcagggaccgactcttcccgtctcatgactgtgtttactgggctggattttgggaaggggccagattgcatcagacagggcctgatgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacagcttgggtgtgtgttcatccttgttctttgtgtgtttttgttcgggcatgtgtgtgcttgcctgtgcctgcacattcatgagcctgagagagcatctttgatgtgtatttgtgtttggtgtatgtatctggggcagggagtgttcctgctcttgcagggtctacgctgtgaatgcagcttttggtttgtttgcttttgcttgcatatattttagtgcatacatttctgtgggctcctacgtagtggaaaggaatttcttctgcttttttgcgatactgcccatgaaacacggccctccccagcacctgtttttgttgattgtgtcctgttcatagacgggaacgctacttatgagtgccatctaaaagtcagagaaaactgagatttaaaatattaaaagccagggccgggggcagtggctcacgcctgtaatcccagcactttgggaggccgaggtgggtggatcacaaagtcaggagttcaagaccagcctgaccaacatggtgaaaccccatctccactaaaaataccaaaaattagccaagcatggtggcaggtgcctgtaatcccagctgctcaggaggctgaggcagtagaatcgcttgaacccaggaggtagaggttgcagtgagccgacatcgtgccattgcactccagcctgggtgacagagggagactctgtctcaaaacaaacaaacaaacaaaaactaaagtctgggagcagtggctcatgcctgtaatcacagcagtttaggaggccgaagtgggaggattacttgagcctaggagtttgagaccagcctgagcatcatagtaagaccccatctctacaattttttttttgagacagagtctcactctgttgctcaggttagagtgcagtggcaccatcttggctcactgcaacctctgcctcccgggttcaagcaattctcgtgcctacgccccctgagtagctgggattacaggtgagcaccaccacgcctggctaatttttgtttttttgtttttttgatacagagtctcactctgttgctcaggctggagtgcagtggcatgatcgcagctcactgcaacctccgcctcctgggttcaagctattctcctgcttcagcctcctgagtagctgggactacaggcacctgccaccatgcctggctaatttttgtatttttagtagaaacagagtttcaccatgttggccaggatggtctcaatctcttgacctcatgatccacccaccttggcctcccaaagtgctgggattacaggcgtcagccaccacgcctggccaatttttgtatttttagtagagatggggtttcatcatgttggccaggctggtctcaaactcctggcctcaaatgatctgcccacctcagccttccagcctttgggaggccaaggagggaggatcgcttgaggccaggagttcgagaccagcctaggcaacataccaaggccctgtctctacaaaaatttaaaaattagcaaagcatggtggctcatgcctgtagtcctagttgctcagaggctgaagttggaggatcccttgaacccagttggaggctacagtaagccatgatggtgccactgcactgcagcctgagcaatagagtgaaaccatgtattgaaaaagaaagaaagaaagaaagagaaaaagaaggaaggaaggaaaagaaaggaaggaagaaagaaaagaaagagagaaaggagagaaaaagaagaaagagagagaaagagaagaaagaaagaaagaaagaaagaaagaaagaaagaaagaaagaaagaaaggaaggaaggaaagaaagaaagaaagaaggaaagaaagaaagaaagaaagaaagaaagaaagaaagaaaagagcgagccccggcacagtggctcacacctgtaatcccagcactttgggaggccaaggcaggcggatcacctgaggtcagtagttcgagttcgaggcagaagttgtggtgagccaagatcacgccattgcactccagcctgggcaacaagagcaaaactccatctcaaaaaaagaaaaagagagagaaagaaagagagaaggagggaaagaaagaggaaggaaaggagggagggaaggagggaaggaggaaaggagggaaggaaatattaagggatttgccctagctcactcagggctcatattcagggatcttattgtcttcagatatgaggtgggtccccaggccaagggggctgtgggacagggttctgggaagtgagatgggggagggagattcttattcagtgctatgtctcaggaccagagttgaagaaaaatatggggcaaacaggaagtgtggttggagctgagattatttgttgattgagatacaggtttgggttgctattatgaagaatcaaaacaggatacaaagttactcctctcttacttagccccaagtcctcctgggttcaaatggcagctccattgtgttgaggattccagctatttttactcactgttctgccacacccaaaacatggcttccactttgaggcccaaaatagctactccaatacctgccatcacgtttgcatctcagcctgtggaaagagtgtggaagagacagaggaggccacacctcttcaattttagggcataatctaaaagtagaacacatcacatctgctccgaatgtggctacatggccacacccaactacgagagaggttgggaaatgtagcattgagctgcttagccacgtggtagccaaaacttgggcaacagcagggttttatgatgaaagggaaccagagagagtgaatacacgaagaagctagcaagaaacattgcccacatgcagactcaacagatgtcgggggagaaaactctgagattgggccccgggcagagcctgtttccttttcccctgtccctttcacataagccccacactgcagaacttggagtcagtggttcatggggacccaaggacatccacagaagaccgaagtacctgatagagcaggaacagatgcacgtcagactacgaccagcttgaacccttggggacctgtatccatccccttcccttgagtccagcctaatcacagccacagaatgaatccatgacccggaaggacatttaaggacctctggcccaactctccccacgcaacagtgggattgcctctgcttgtttgaataccactatggagggggaacttgctacatttaaaggttgctgaatttttttgttttgttttgggagatggagtctctctctgtcgcccaggctggagtgcagtggtgtgatctcgacccactgcaacctccgcttcctgggttcaagcgattttcatgcctcagcctccctagtagctgggactacaggtgtgggccaccacacctggctaatttttgtatttttagtagagacggggtttcaccatgttgcccaggctggtctcaaactcccgacctcaggtgatctgcctgccttggcctcccaaagtgttgggattacaggcttgagccacaccacccggcaaaggttgcctaattctatctcagggcaagtctgttcatgtgggctgaaatctgtctctcatacctgcccttaaataagcttctgtttttctggtcctttctgtctgagatgactttaattcctcccccgaccccatctcatgaggctcagcttagatgtttccttctcttcctccctgatggctgcgtgcagaagctcatacctgcaatcccagcactttgggaggccgaggtgggaggattgcttgggcccaggagttctaggccagcctagcaacacagcaagaccctctctctacaaaaaattaaaaattagccaggtgtggtggcttgtgcctgtgggcccacctactcaggaggctgaggtgagaggatctcttgagtctgggaggtggaggctgcagtgagccatgatctcactccagcctgggcgtcagagtgagacctgtctcaaaaaaacaaaaaccaaagttttccttaacttgcaatcctccacccatctcctgacctccaccccaggccgaccctcctctgggatcacacggaagcctgggcccagaatcttacagtctaccttggaaatccttcagattttgcctccaactcctctttccatacaagttacatattaactcaatcaatgcttattggatgccttctgagttaccaggatgctgctggaggcctgtgctgctgagagggacaaatagaatcctgatatgactggaaccaggaatagggccaccatcagctctagaacccagggagcaaatggcaggagcaacaccaggcagtcggccctcagcccagcacagacctggtgtgttggcttcagaaaatcctggaaacatctctgctgtgtttggagctcctattctgtgagaagtgttttataggctttgctccatttaatccttacgataacccaataggacatactattaatgatcccctttttttcagaccggaaaactgaggttcggagacattaagtaatttgcctaaagtcacacagccacatcctgtaggacttggaattatgaactcaggtctatctgaattttaaagcctggatttttccccctttgctacatgcctgggaagaaccatgtattgacaatgaagaatcctaaactctcgttaa

SEQ ID NO: 160719 - DNA, 550 bp, Homo sapiens
  Payload ID: 11407
  Gene Symbol: NUPR1
  Gene Name: nuclear protein, transcriptional regulator, 1
  Uniprot ID: O60356
  ENST ID: ENST00000395641
  CDS Start-End: 102-404
agccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcgggcctctcatcatgcctatgcccacttcacctctgactcctgccttggttacaggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctg

SEQ ID NO: 160720 - DNA, 598 bp, Homo sapiens
  Payload ID: 11407
  Gene Symbol: NUPR1
  Gene Name: nuclear protein, transcriptional regulator, 1
  ENST ID: ENST00000567646
  CDS Start-End: 45-176
agcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggctggagtgcagtagtgtgatcacaacaactcaaacaactcaccgcagcctcgaactcctgggctcaagtgatcctcctgcttcagcctcctgagtggctggaacttcaggtgtacaccacctgcagtggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccct

SEQ ID NO: 160721 - DNA, 603 bp, Homo sapiens
  Payload ID: 11408
  Gene Symbol: NUPR1L
  Gene Name: nuclear protein, transcriptional regulator, 1-like
  Uniprot ID: A6NF83
  ENST ID: ENST00000329309
  CDS Start-End: 87-380
atcggaactcgaggcggggctgctgggtcttccaggagcgcccagacgcgggcaggtggccgccggtggccacaggcctgggcaggatggaagcgcccgcagagcgggcgcttccacgtctgcaggctctggctcggccgccgccacccataagctacgaggaggagctttacgactgcctggactactactacctgcgcgacttcccggcctgcggggcagggcgcagcaagggccggactcggcgcgagcaggcgctgcgcaccaactggcctgcacctggcgggcacgagcgcaaggtcgcgcagaagctcctcaatggccagcgcaagcgccgccagcgccagctgcatcccaagatgcgcactcgcctcacctgagcctgggataccgaaggacctgttcgaagtatttactgtaactccaactgtaacttggttctgaggaggagagaatccatgtttggtcaacagaacttttcgctgtcacttaagtttactgcttcgatatcttttccttactaattgattgttaattaagtagtgcccaagtggattagcctttttagagtttattaattaaaagagagcagcaagaatggca

SEQ ID NO: 160722 - DNA, 1293 bp, Homo sapiens
  Payload ID: 11409
  Gene Symbol: NR2C2AP
  Gene Name: nuclear receptor 2C2-associated protein
  Uniprot ID: Q86WQ0
  ENST ID: ENST00000331552
  CDS Start-End: 365-784
ccaagcccacgcggttccgggtcccaagatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccagggcccctcccagtgggtgacgctggagtttccccagctcatccgtgtctcccagctgcagatccagtttcagggtggcttctccagtcgccggggctgcctggaaggttcacagggcactcaggctctccacaagattgtagatttctaccctgaggacaacaactcgcttcagactttccccataccagctgctgaagtggaccggctgaaggtgacgtttgaggatgccactgacttttttggccgtgtggtcatctaccacctgcgggtgcttggggagaaggtgtgagacctctaggggctgtctcctccaggaagccctccgggaagcacagcaaagtccctcattctgcacagaaggtttattggttcctcttgggaagggtcccctcccaccacctgtccagaagctgcctttgaagtcagttctgggtttccccagctctggctgaccattttgttccctgagtgtctgagtccccggcaggcggccttcactcagggtcagcgggcaccaggttgctctggaagagcttgaggatgtggttctcgatcacctgttgcactgagatggggcagggaaaaggtgggctgtgagcttgaatcgggagtggggtggaggcacaggccaacctgcgctctccccttaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctacca

SEQ ID NO: 160723 - DNA, 859 bp, Homo sapiens
  Payload ID: 11409
  Gene Symbol: NR2C2AP
  Gene Name: nuclear receptor 2C2-associated protein
  Uniprot ID: Q86WQ0
  ENST ID: ENST00000420605
  CDS Start-End: 298-801
acaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccagggcccctcccagtgggtgacgctggagtttccccagctcatccgtgtctcccagctgcagatccagtttcagggtggcttctccagtcgccggggctgcctggaaggttcacagggcactcaggctctccacaagattgtagatttctaccctgaggacaacaactcgcttcagactttccccataccagctgctgaagtggaccggctgaaggtgacgtttgaggatgccactgacttttttggccgtgtggtcatctaccacctgcgggtgcttggggagaaggggacaaacagggacccttgcagagacctgcattacagagcaaagctgggagaaccgaggactcaccccaggaacctcaacttcccctaagtttgtaaaaatgcacttttgtagcttttcagaattaatataaaaatatttcctacca

SEQ ID NO: 160724 - DNA, 899 bp, Homo sapiens
  Payload ID: 11409
  Gene Symbol: NR2C2AP
  Gene Name: nuclear receptor 2C2-associated protein
  ENST ID: ENST00000544883
  CDS Start-End: 300-464
gcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccaggttcacagggcactcaggctctccacaagattgtagatttctaccctgaggacaacaactcgcttcagactttccccataccagctgctgaagtggaccggctgaaggtgacgtttgaggatgccactgacttttttggccgtgtggtcatctaccacctgcgggtgcttggggagaaggtgtgagacctctaggggctgtctcctccaggaagccctccgggaagcacagcaaagtccctcattctgcacagaaggtttattggttcctcttgggaagggtcccctcccaccacctgtccagaagctgcctttgaagtcagttctgggtttccccagctctggctgaccattttgttccctgagtgtctgagtccccggcaggcggccttcactcagggtcagcgggcaccaggttgctctggaagagcttgaggatgtggttctcgatcacctgttgcactgagatggg

SEQ ID NO: 160725 - DNA, 891 bp, Homo sapiens
  Payload ID: 11409
  Gene Symbol: NR2C2AP
  Gene Name: nuclear receptor 2C2-associated protein
  ENST ID: ENST00000538165
  CDS Start-End: 316-699
gcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagccaagatcgcgccgccctgtagcttgaggaggcgccgggattcgaaccaaggctgtgcccaatcctaagccctgcgaggtcttgtggaaccgacatgacccactctttggtttgtccagagacagtgagcagggtgagttcagtgctgaatcgcaacactcggcagtttggaaaaaaacatcttttcgaccaggatgaggagacatgttggaactcagaccagggcccctcccagtgggtgacgctggagtttccccagctcatccgtgtctcccagctgcagatccagtttcagggtggcttctccagtcgccggggctgcctggaaggttcacagggcactcaggctctccacaagattgtagatttctaccctgaggacaacaactcgcttcagatatcctgcccctgcttctggggtgggtggtctgtgcctctggaagctttggactcacccaaacccgaatgggaaccctgatgtgtgatcttgaacacgtgacctctaggactccactttttctgtaaaatggtgctgatgaccacctgttctgtgtgagaggcttagagggacctgcagcttccccaggttgcccacatcggtggagtgtgagctgggtctggaaggggtgggggcctgcgggtgggaaaccagaaatcaccagtttccctt

SEQ ID NO: 160726 - DNA, 375 bp, Homo sapiens
  Payload ID: 11409
  Gene Symbol: NR2C2AP
  Gene Name: nuclear receptor 2C2-associated protein
  ENST ID: ENST00000539678
  CDS Start-End: 1-90
ggaaaaaaacatcttttcgaccaggatgaggagacatgttggaactcagaccaggttcacagggcactcaggctctccacaagattgtagatttctaccctgaggacaacaactcgcttcagatatcctgcccctgcttctggggtgggtggtctgtgcctctggaagctttggactcacccaaacccgaatgggaaccctgatgtgtgatcttgaacacgtgacctctaggactccactttttctgtaaaatggtgctgatgaccacctgttctgtgtgagaggcttagagggacctgcagcttccccaggttgcccacatcggtggagtgtgagctgggtctggaaggggtgggggcctgcgggtgggaaacc

SEQ ID NO: 160727 - DNA, 1853 bp, Homo sapiens
  Payload ID: 11410
  Gene Symbol: NRBF2
  Gene Name: nuclear receptor binding factor 2
  Uniprot ID: Q96F24
  ENST ID: ENST00000277746
  CDS Start-End: 182-1045
cgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccacatgcagaaactgctacagcctcctcaacctggcagaagttcgcagcaaatactgggaaagccaaggacattccaatccccaatcttcctcccttggattttccatctccagaacttcctcttatggagctctctgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtggccggaggggctgccttatatttgaaacatgctttctatcatgcattgactgtatgcattttgttaatgcacattctgtttgtttaaggtgtgtaagatacacacccttctagatgaaactatatgtgccacactttgcactactcataatgataacctcaagactatcagaagaaatatttaaatttccattttatgaagaaaggaaccaaattattatgctttttaaaacaaattaccagtttacataattaatcagggtgcattttaagttctaacttcgtttattgtataatgcatcatttgaaaataccaaggaggaaataccctttgtttttaatgatgcaagagtggacgtaatgctagttggcagtattttattgtaagaaatcaataaagtaattgtgttttata

SEQ ID NO: 160728 - DNA, 1816 bp, Homo sapiens
  Payload ID: 11410
  Gene Symbol: NRBF2
  Gene Name: nuclear receptor binding factor 2
  Uniprot ID: Q96F24
  ENST ID: ENST00000435510
  CDS Start-End: 170-1003
atggcgccgtgcgtggcctcggcggtggcgcagggggcgggcccgcggcgcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctgcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccacatgcagaaactgctacagcctcctcaacctggcagaagttcgcagcaaatactgggaaagccaaggacattccaatccccaatcttcctcccttggattttccatctccagaacttcctcttatggagctctctgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggttaaaatgtataaaagttatgtgtaattaatctataatgccataaatgataatgcaaaacctaaataatatggtggccggaggggctgccttatatttgaaacatgctttctatcatgcattgactgtatgcattttgttaatgcacattctgtttgtttaaggtgtgtaagatacacacccttctagatgaaactatatgtgccacactttgcactactcataatgataacctcaagactatcagaagaaatatttaaatttccattttatgaagaaaggaaccaaattattatgctttttaaaacaaattaccagtttacataattaatcagggtgcattttaagttctaacttcgtttattgtataatgcatcatttgaaaataccaaggaggaaataccctttgtttttaatgatgcaagagtggacgtaatgctagttggcagtattttattgtaagaaatcaataaagtaattgtgttttataccttt

SEQ ID NO: 160729 - DNA, 1228 bp, Homo sapiens
  Payload ID: 11410
  Gene Symbol: NRBF2
  Gene Name: nuclear receptor binding factor 2
  ENST ID: ENST00000611479
  CDS Start-End: 167-988
gaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctatggaagtaatggaaggacccctcaacctggctcatcaacagagcagacgagcagaccgtttattagctgcaggcaaatacgaagaggctatttcttgtcacaaaaaggctgcagcatatctttctgaagccatgaagctgacacagtcagagcaggctcatctttcactggaattgcaaagggatagccatatgaaacagctcctcctcatccaagagagatggaaaagggcccagcgtgaagaaagattgaaagcccagcagaacacagacaaggatgcagctgcccatcttcagacatctcacaaaccctctgcagaggatgcagagggccagagtcccctttctcagaagtacagcccttccacagagaaatgcctgcctgagattcaggggatctttgacagggatccagacacactactttatttacttcagcaaaagagtgagccagcagagccatgtattggaagcaaagccccaaaagatgataaaacaattatagaggagcaggcaaccaaaattgcagatttgaagaggcatgtggaattccttgtggctgagaatgaaagattaaggaaagaaaataaacaactaaaggctgaaaaggccagacttctaaaaggtccaatagaaaaggagctggatgtagatgctgattttgtagaaacgtcagagttatggagcttgccaccaagaaactgctacagcctcctcaacctggcagaagttcgcagcaaatactgggaaaggacattccaatccccaatcttcctcccttggattttccatctccagaacttcctcttatggagctcttgaggatattctgaaaggatttatgaataattaaaatggaaggccacagaaaaggggaaaagaggaaataatacagtaatcgttaatccagcaaaaagaaatgaaaagggaaaaccacatagaagggtaatcccggaaatgcttcatctggtggactgtgggagcagaggcattgccaggacttgggaaacagtcactgtgaaatgcgctgcgtatctcattcactcacttcagctaatgatt

SEQ ID NO: 160730 - DNA, 2887 bp, Homo sapiens
  Payload ID: 11411
  Gene Symbol: NRBP1
  Gene Name: nuclear receptor binding protein 1
  Uniprot ID: Q9UHY1
  ENST ID: ENST00000233557
  CDS Start-End: 833-2440
atcatacacgtctaagggcagagtgaacttccatcctgaaggctccgcgcttagttttcgcagattaatagctcaccaagaatttatcatcttttctttccactaactcgaaaccaatctaaattctttccaaacatcttctcaacgtagtctcctttgatgaaatttactgtttcggattctagacttggctcttaccaacttaactttcggttaatagcttaatacctctgattcaggtttttgcatttgtcaactaccattgaatgataatttcaatgagttcgttcttatgaggatcaaatgaaataacatctgtgaaaacctcttacaaagtttaagcaaatagtgctaagcaatcaccaagcgttaactactaattttcagtgttaggcattagaactgtcatggcgccttcaagaagaggtaggaggccctctctgcgtccagcagaaccatctggggcacctggaccgggcggtggggtggacagagagacgagccccagctgggaccgaaaacatcgacccctccgagaggtctcggccggaccggcgcaaggggaggagagcgggtggaagcccaccccagcgaacgcccgagggccgggccccgcccacccagaacgtcacccaatggaaacctgccggcggtgcggcaccgcccatcgttggtccgggcgccgcgagggcggggcccgcagttcggttgcgctgcggagcgcagctgtgagggagtcgctgtgatccggggccccggaacccgagctggagctgaagcgcaggctgcggggcgcggagtcgggagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgctaaaa

SEQ ID NO: 160731 - DNA, 2163 bp, Homo sapiens
  Payload ID: 11411
  Gene Symbol: NRBP1
  Gene Name: nuclear receptor binding protein 1
  Uniprot ID: Q9UHY1
  ENST ID: ENST00000379852
  CDS Start-End: 113-1720
gcggagcgcagctgtgagggagtcgctgtgatccggggccccggaacccgagctggagctgaagcgcaggctgcggggcgcggagtcgggaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgct

SEQ ID NO: 160732 - DNA, 2174 bp, Homo sapiens
  Payload ID: 11411
  Gene Symbol: NRBP1
  Gene Name: nuclear receptor binding protein 1
  ENST ID: ENST00000379863
  CDS Start-End: 100-1731
gtgagggagtcgctgtgatccggggccccggaacccgagctggagctgaagcgcaggctgcggggcgcggagtcgggaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatctgggagtctgaagcaatttctgaagaagaccaaaaagaaccacaagacgatgaatgaaaaggcatggaagcgttggtgcacacaaatcctctctgccctaagctacctgcactcctgtgacccccccatcatccatgggaacctgacctgtgacaccatcttcatccagcacaacggactcatcaagattggctctgtctttcataggatttttgctaatgtggctcctgacactatcaacaatcatgtgaagacttgtcgagaagagcagaagaatctacacttctttgcaccagagtatggagaagtcactaatgtgacaacagcagtggacatctactcctttggcatgtgtgcactggagatggcagtgctggagattcagggcaatggagagtcctcatatgtgccacaggaagccatcagcagtgccatccagcttctagaagacccattacagagggagttcattcaaaagtgcctgcagtctgagcctgctcgcagaccaacagccagagaacttctgttccacccagcattgtttgaagtgccctcgctcaaactccttgcggcccactgcattgtgggacaccaacacatgatcccagagaacgctctagaggagatcaccaaaaacatggatactagtgccgtactggctgaaatccctgcaggaccaggaagagaaccagttcagactttgtactctcagtcaccagctctggaattagataaattccttgaagatgtcaggaatgggatctatcctctgacagcctttgggctgcctcggccccagcagccacagcaggaggaggtgacatcacctgtcgtgcccccctctgtcaagactccgacacctgaaccagctgaggtggagactcgcaaggtggtgctgatgcagtgcaacattgagtcggtggaggagggagtcaaacaccacctgacacttctgctgaagttggaggacaaactgaaccggcacctgagctgtgacctgatgccaaatgagaatatccccgagttggcggctgagctggtgcagctgggcttcattagtgaggctgaccagagccggttgacttctctgctagaagagaccttgaacaagttcaattttgccaggaacagtaccctcaactcagccgctgtcaccgtctcctcttagagctcactcgggccaggccctgatctgcgctgtggctgtccctggacgtgctgcagccctcctgtcccttccccccagtcagtattaccctgtgaagccccttccctcctttattattcaggagggctgggggggctccctggttctgagcatcatcctttcccctcccctctcttcctcccctctgcactttgtttacttgttttgcacagacgtgggcctgggccttctcagcagccgccttctagttgggggctagtcgctgatctgccggctcccgcccagcctgtgtggaaaggaggcccacgggcactaggggagccgaattctacaatcccgctggggcggccggggcgggagagaaaggtggtgctgcagtggtggccctggggggccattcgattcgcctcagttgctgctgtaataaaagtctactttttgct

SEQ ID NO: 160733 - DNA, 674 bp, Homo sapiens
  Payload ID: 11411
  Gene Symbol: NRBP1
  Gene Name: nuclear receptor binding protein 1
  ENST ID: ENST00000419281
  CDS Start-End: 210-674
gaggtggccgccgctggctccctgggccccagcctggttcccgcgcgggccgcggctgccttccagacgcagggcatgcgacctgttggagtgtgaaattctaggggccgggttcctccccagagcggttttatttccgactggactgtgctgcgggtctcagaggccctctggtccgttcaggtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgcatacctggccatggatacagaggaaggtgtagaggttgtgtggaatgaggtacagttctctgaacgcaagaactacaagctgcaggaggaaaaggttcgtgctgtgtttgataatctgattcaattggagcatcttaacattgttaagtttcacaaatattgggctgacattaaagagaacaaggccagggtcatttttatcacagaatacatgtcatct

SEQ ID NO: 160734 - DNA, 585 bp, Homo sapiens
  Payload ID: 11411
  Gene Symbol: NRBP1
  Gene Name: nuclear receptor binding protein 1
  ENST ID: ENST00000356442
  CDS Start-End: 341-585
gtgtagagaagggatggatagtgaatgccaaggttagttctagctggataaattagccaagggtttcagctggataagttggctgagggtgctacaggtctagccttaaggctgtctcactgaaacattttggagtctggagtcatctgttctgaatagcgcccacatagtttatatttttttattttttgagacagagtctcactctgttgcccaagctggagtgcagtggcacgatctcagctcactgcaacctctgcctcccgggttcaagtgattctcctgcctcagcctcctgagtagctgggactacagtgcaggcctgagtgttccttccagcatgtcggagggggagtcccagacagtacttagcagtggctcagacccaaaggtagaatcctcatcttcagctcctggcctgacatcagtgtcacctcctgtgacctccacaacctcagctgcttccccagaggaagaagaagaaagtgaagatgagtctgagattttggaagagtcgccctgtgggcgctggcagaagaggcgagaagaggtgaatcaacggaatgtaccaggtattgacagtgc

SEQ ID NO: 160735 - DNA, 3587 bp, Homo sapiens
  Payload ID: 11412
  Gene Symbol: NRBP2
  Gene Name: nuclear receptor binding protein 2
  Uniprot ID: Q9NSY0
  ENST ID: ENST00000442628
  CDS Start-End: 141-1646
aattcccagagccggggctggggctctaggctgccgcggcggctctaggctgggctgctgggcgcgaggccagggcgggccgggagaggctgcgccggcggcggatcgcgcagagggcggtggcctgggctggccgaaccatggcggccccggagccggcgccgaggcgggcccgggaacgggagcgggagcgggaggacgagagcgaggacgagagcgacatcctggaggaaagcccgtgtggtcgctggcaaaagcgacgggagcaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcgggagttcatcctttgctgcctggcccgggaccctgcccgccggccctctgcccacagcctcctcttccaccgcgtgctcttcgaggtgcactcgctgaagctcctggcagcccactgcttcatccagcaccagtacctcatgcctgagaatgtggtggaggagaagaccaaggccatggacctgcacgcggtcttggcggagcttccccggccccgcaggcccccgctgcagtggcggtactcggaagtctccttcatggagctggacaaattcctggaggatgtcaggaatggaatctacccactgatgaactttgcagccactcgacccctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaacggacagcgcccaggacctcgcctcggagctcgtgcactatggcttcctccacgaggacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctgagaccagaacttgcagcccctctgcagatctcctctggccactgcagcccctccaatgggctttttctctcatgcattccctggcctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctctcctccaattccaaacttagtgaaatggccttaagcattttaaactgtatgtatacattagcgcattcatgcctttctaaacgcatttcaaatgtcaaccaggaaggcacaccactgtattagttttatactgccgctgtaaaatttaccacaaacttagtgacttaacacaaatttattgcaattctgtaggctggaagtctgactatgggtctcactggactagaatcaaggctggcaggctgccttccttcctggaggttctaggggagactctgtctcctgctccttcaggctgctggcagaatccacatcctttcggtggcagggccaaggtccccactttcttgctgactgtaaactaaggccacttccagcttgtagaggctgcctacattccttggctcttggccccctcctccatcttcagagctagcaggttcagtctgtgtcacgaaccatttctctggttccctgcagacaggaaaggttgtccctaaggactcatgagattaggttgggcccagccagataatacatgataatctccctcctcaaggtttttaatattaaacacatctgcaggacacattttgccatgtaaactaacattcactggttccagggattaaggaatgaacctcttttgttggggaagggtggcattctgctgaccacagcactccaaccaaaagccaaaaaccaaagcaagacttactaacgcatatcaaataaattaaaggtacaaaatcgtgaatctcagttatcttaaatattccaatactatttacaaaattattcaaattctcacgccttccaactcaaaattagcaatctaaagtaatttccatatcctagatggaaaccctcatgctaaactgtctgattatgcatggttctaaatggtttcagtggcaaatacataacattgtactactgattaaactgaacttaaaagcatcaataccaccattgctgcacttaa

SEQ ID NO: 160736 - DNA, 925 bp, Homo sapiens
  Payload ID: 11412
  Gene Symbol: NRBP2
  Gene Name: nuclear receptor binding protein 2
  ENST ID: ENST00000530123
  CDS Start-End: 1-505
cctggggctgccccgtgtgctggccccacccccggaggaggtccaaaaggccaagaccccgacgccagagccctttgactctgagaccagaaaggtcatccagatgcagtgcaacctggagagaagcgaggacaaggcgcgctggcatctcactctgcttctggtgctggaagaccggctgcaccggcagctgacctacgacctgctcccaagacgaccggatgaagctggccgccttcctggagagcaccttcctcaagtaccgtgggacccaggcctgacccggagccccagccccaggggaccatgccggggtgctgcctgggcaggccatgttggggagactccagcaccgtggggctgccctcctccatgcgcctgggagcacaaaggccccggtagtgaaggaaccccccgtctcctgagagtggggctgaccctgccttgggcgccgaggggttggggggtgggtgtgggggagccgttaggcctcccaggtccttaggatcagggttgcccccagaaccccttcccatatcctccattctccgccctgagttcctacccaggctgcctggccggggccactgcctcctcagcatgcaggaggctgccctgtagggaaccccagctctggggcttgggggtgagggtcagccctggacagacctctgcccagggaactgctccatggggtctgggagagcagccatcccctgctggcaccatagacccacacaaggagcctgcacagcaagccagcggtgacacacctgcaggtgtcaggcatggcactgggcacaacagggacctggcaggagaaacagaccacagagaggtctggagttgaggctgttgtcagcaaagcccctggtcccacacagctctgccctagagccacctctttgaccctttacccaccctg

SEQ ID NO: 160737 - DNA, 1037 bp, Homo sapiens
  Payload ID: 11412
  Gene Symbol: NRBP2
  Gene Name: nuclear receptor binding protein 2
  ENST ID: ENST00000530347
  CDS Start-End: 341-1037
gggggcgctgggagagcgcggcggctggaaacctctccgcggcccctcgcggcccgcgaatcagccacccctggacccctttggcctggcgctcgccctgggactccctgagggccagtctcctcccaggaccacctccccatgcctctggactcagccgctagcttcctggggatccccctcgaccccctgaaacctgctccaaatccccttagcccagcccttggataggagcccttggctcctgggggcagctaccctccaagccccaccttcccgcagagtggctcagggcctgcagcccacgcttgggcccactggaaaggtaaaccaagggaacatgccagggcttcagagcaccttcctagccatggacacggaggagggggtagaggtggtgtggaacgagctccacttcggagacaggaaggccttcgcggcgcacgaggagaagatccagaccgtgttcgagcagctggtgctggtggaccacccgaacatcgtgaagttgcacaagtactggctggatacctctgaggcctgcgcgagggtcatcttcatcacagagtacgtgtcatcaggcagcctcaagcaattcctcaaaaagaccaagaagaaccacaaggccatgaacgcccgggcctggaagcgctggtgcacgcagatcctgtctgcgctcagcttcctgcacgcctgcagccccccaatcatccacgggaacctgaccagcgacaccatcttcattcagcacaacggcctcatcaagatcggctccgtgtggcaccgaatcttctccaatgcacttccagatgatctccgaagccccatccgcgctgagcgagaggaacttcggaacctgcacttcttccccccagagtatggagaggtggccgatgggaccgctgtggacatcttctcctttgggatgtgtgcgctggagatggctgtactggaaatccagaccaatggggacacccgggtcacagaggaggccattgctcgcgccaggcactcgctgagtgaccccaacatgcggg

SEQ ID NO: 160738 - DNA, 7688 bp, Homo sapiens
  Payload ID: 11413
  Gene Symbol: NSD1
  Gene Name: nuclear receptor binding SET domain protein 1
  Uniprot ID: Q96L73
  ENST ID: ENST00000347982
  CDS Start-End: 102-7385
cctccgcctcccctcaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccattgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaa

SEQ ID NO: 160739 - DNA, 12195 bp, Homo sapiens
  Payload ID: 11413
  Gene Symbol: NSD1
  Gene Name: nuclear receptor binding SET domain protein 1
  Uniprot ID: Q96L73
  ENST ID: ENST00000354179
  CDS Start-End: 161-7444
ggccgggtagggggttcgcctgcggccgcgtctgctcggggcctgaggcctcgaagaccccagcccaagcccccaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccattgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaagtatggaattcaattccgctggtcaggttggaaggtataggggctctcaaagcgatttccccaaccagacagagccccattgagggcacctaggaacccttgggaggaaatggtgttctttcaaatcagtggcgatttcctgagcattcacgtgttctaggccgggtgctagtcactgatgagagatacaggcctcatccctgtgagcctggattccaaggctttcaggaacctttgaccaggaagtaacaggaagttctgaggggccctggggctttagactcattttgaaatgtcctttgtggcaccagaagtggttgtgttgaggaagtgtctcttggctgcggtgtgcatgggtgcgtgtgcatgcgcgcacactcacagaggtctcctctatagatgcaagggtgctgcattgaggccagcaaggctgttggctgtggggtcgccgctgctgcttttgtctgggctgtgcagagtctcaagatcagtccttggaggagcaggtggtcaggggcagtcgggctctgtgcgaatgtagatttccagcagtggaagaaggcatttggcaagcttctctttctttgcttttgtttctacctatttttctctttgtacatgaatccaccccatccctatttccctaaaacactcaggtgctttcagatttcagagcctcgggcagtggacatagggaatctctggcaagctctgagctagacacaccagcttcaggaagagtaccagatcctgatgggaaatttcttttccccattccttttccctcctgagtggagggagtcctcttcttcgcctccctgagaattgctgtgctctgtattgagagcacctgcctgctgacttagctcaaaggcaagccagaacccttccctgaagactggcaagaggtggtgtttagagcaacgtccaggctaagagatgactcctattaactgctgattatctgttactgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctttatctaaagattaaaaatagaatctgcttttatttcccaaagtctgtctctgaggttgagacacttgaactcaggcagagggacgaggctgggcagggctgtcctgagtttaggggcctatccctgcatttcactgagacctcggaatctcctctgtgaattccacctgcctagttctcccctttcatcctctctctcttcccacatcatcaaagaggaaaagctctttgttcaaaaggaagagaaaacgtaaagcatcttattttcttttaaaagaattttaaaccatgaaaaagatatttttaaagaaattcaccgagaacattaaagttcattatattaagtatttatcatgtgtgagaataataaatatataactgcagctagtaggtccctttccctaatcttttaggtcatatgagtagggtttgcttggtgccagtcctgtgcccttttctctccagtcatctgtagttgtgatcagaaaaaggtatctgcactgcactgtcagagtctcctttcactatgttgtgtgttaaattaccgtagctctttgtttcatgaaataaactgtgaatttggggggggcggggggagggcgtgcaggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtttcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgcccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactc

SEQ ID NO: 160740 - DNA, 442 bp, Homo sapiens
  Payload ID: 11413
  Gene Symbol: NSD1
  Gene Name: nuclear receptor binding SET domain protein 1
  ENST ID: ENST00000375350
  CDS Start-End: 1-195
gataaatccagtgccagcattggtgacatggaaaaggagccaggaattcccagtttgacaccacaggctgagctccctgaaccaggtggagtcttgctctgtcacccaggctggagtgcagtggcacgatctaggctcactgcaacctccgcctcccaggttcaagtgattctcctgtctcaccctcctgagtagctgcaactacagctgtgcggtcagagaagaaacgccttaggaagccaagcaagtggcttttggaatatacagaagaatatgatcagatatttgctcctaagaaaaaacaaaagaaggtacaggagcaggtgcacaaggaaattatgaaagtaaacgtcaaagaaaaccaactaagaaacttcttgaatccaatgatttagaccctggatttatgcccaagaagggggaccttggcctttctaaaaag

SEQ ID NO: 160741 - DNA, 12892 bp, Homo sapiens
  Payload ID: 11413
  Gene Symbol: NSD1
  Gene Name: nuclear receptor binding SET domain protein 1
  Uniprot ID: Q96L73
  ENST ID: ENST00000439151
  CDS Start-End: 46-8136
gctggcccgggagggggcgcggggcacggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatatttgctcctaagaaaaaacaaaagaaggtacaggagcaggtgcacaaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggaaattatgaaagtaaacgtcaaagaaaaccaactaagaaacttcttgaatccaatgatttagaccctggatttatgcccaagaagggggaccttggcctttctaaaaagtgctatgaagctggtcacctggagaatggcataactgaatcttgtgccacatcttattcaaaagattttggtggaggcactaccaagatatttgacaagccaaggaagcgaaaacgacagaggcatgctgcagccaagatgcagtgtaaaaaagtgaaaaatgatgactcgtcaaaagagattccaggctcagagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcagaattgtgaaaaattgggtgagctgctgttatgtgaggctcagtgctgtggggctttccacctggagtgccttggattgactgagatgccaagaggaaaatttatctgcaatgaatgtcgcacaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaagggtgaatttgtgaatgagtatgtgggtgagcttatagatgaagaagaatgcagagctcgaattcgctatgctcaagaacatgatatcactaatttctatatgctcaccctagacaaagaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggcactgaacttaccttcaactacaacctagaatgtcttgggaatggaaagactgtttgcaaatgtggagccccgaactgcagtggcttcttgggtgtaaggccaaagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccattgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaagtatggaattcaattccgctggtcaggttggaaggtataggggctctcaaagcgatttccccaaccagacagagccccattgagggcacctaggaacccttgggaggaaatggtgttctttcaaatcagtggcgatttcctgagcattcacgtgttctaggccgggtgctagtcactgatgagagatacaggcctcatccctgtgagcctggattccaaggctttcaggaacctttgaccaggaagtaacaggaagttctgaggggccctggggctttagactcattttgaaatgtcctttgtggcaccagaagtggttgtgttgaggaagtgtctcttggctgcggtgtgcatgggtgcgtgtgcatgcgcgcacactcacagaggtctcctctatagatgcaagggtgctgcattgaggccagcaaggctgttggctgtggggtcgccgctgctgcttttgtctgggctgtgcagagtctcaagatcagtccttggaggagcaggtggtcaggggcagtcgggctctgtgcgaatgtagatttccagcagtggaagaaggcatttggcaagcttctctttctttgcttttgtttctacctatttttctctttgtacatgaatccaccccatccctatttccctaaaacactcaggtgctttcagatttcagagcctcgggcagtggacatagggaatctctggcaagctctgagctagacacaccagcttcaggaagagtaccagatcctgatgggaaatttcttttccccattccttttccctcctgagtggagggagtcctcttcttcgcctccctgagaattgctgtgctctgtattgagagcacctgcctgctgacttagctcaaaggcaagccagaacccttccctgaagactggcaagaggtggtgtttagagcaacgtccaggctaagagatgactcctattaactgctgattatctgttactgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctttatctaaagattaaaaatagaatctgcttttatttcccaaagtctgtctctgaggttgagacacttgaactcaggcagagggacgaggctgggcagggctgtcctgagtttaggggcctatccctgcatttcactgagacctcggaatctcctctgtgaattccacctgcctagttctcccctttcatcctctctctcttcccacatcatcaaagaggaaaagctctttgttcaaaaggaagagaaaacgtaaagcatcttattttcttttaaaagaattttaaaccatgaaaaagatatttttaaagaaattcaccgagaacattaaagttcattatattaagtatttatcatgtgtgagaataataaatatataactgcagctagtaggtccctttccctaatcttttaggtcatatgagtagggtttgcttggtgccagtcctgtgcccttttctctccagtcatctgtagttgtgatcagaaaaaggtatctgcactgcactgtcagagtctcctttcactatgttgtgtgttaaattaccgtagctctttgtttcatgaaataaactgtgaatttggggggggcggggggagggcgtgcaggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtttcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgcccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcatata

SEQ ID NO: 160742 - DNA, 561 bp, Homo sapiens
  Payload ID: 11413
  Gene Symbol: NSD1
  Gene Name: nuclear receptor binding SET domain protein 1
  ENST ID: ENST00000504457
  CDS Start-End: 534-561
actcgatgccgatgaccttgcgggcccggccttggcggcgaacatgcagaggatgcttgtgtccgagcccacatccagcaccaccttgtctttaaagaggtggcggttgtgaaacatggagttgccgaagtgggcgtaggagtcaaagtagtaatctttggacgtcatgccctcgacgttcggcttctcgctgctttccgcctggccacaggacacctccatgatgcagttcacgacctcggcggccgccatcttcacccgcacctactcctcttccggccgccaagacccccgcctttttctatagtaggattttaagaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccag

SEQ ID NO: 160743 - DNA, 513 bp, Homo sapiens
  Payload ID: 11413
  Gene Symbol: NSD1
  Gene Name: nuclear receptor binding SET domain protein 1
  ENST ID: ENST00000515735
  CDS Start-End: 356-513
atcttcacccgcacctactcctcttccggccgccaagacccccgcctttttctatagtaggattttaagaggtgaaagaagcacagtgagaacaagattaactcggatatattctttgctaaggctttactccccacttcagggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttca

SEQ ID NO: 160744 - DNA, 585 bp, Homo sapiens
  Payload ID: 11413
  Gene Symbol: NSD1
  Gene Name: nuclear receptor binding SET domain protein 1
  ENST ID: ENST00000508896
  CDS Start-End: 120-585
acaagcccgacttcacccgccctgaaccccgaagagttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtg

SEQ ID NO: 160745 - DNA, 533 bp, Homo sapiens
  Payload ID: 11413
  Gene Symbol: NSD1
  Gene Name: nuclear receptor binding SET domain protein 1
  ENST ID: ENST00000510954
  CDS Start-End: 161-533
ggccgggtagggggttcgcctgcggccgcgtctgctcggggcctgaggcctcgaagaccccagcccaagcccccaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaag

SEQ ID NO: 160746 - DNA, 578 bp, Homo sapiens
  Payload ID: 11413
  Gene Symbol: NSD1
  Gene Name: nuclear receptor binding SET domain protein 1
  ENST ID: ENST00000503056
  CDS Start-End: 296-578
atgtagaacaccgtctgcttccagtgcgtgtacagggactcgggtatggtggagaagccggtccctccggtcctcttgtggcagaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaagctcttcaggaagctgcagcaaggtttgaggaattaaaggcccaaaaagagctaagacagctgcaggaagaccgaaagaatgacaagaagccaccaccttataaacatataaaggtaaaccgtcctattggca

SEQ ID NO: 160747 - DNA, 519 bp, Homo sapiens
  Payload ID: 11413
  Gene Symbol: NSD1
  Gene Name: nuclear receptor binding SET domain protein 1
  ENST ID: ENST00000505395
  CDS Start-End: 505-519
atgcagaggatgcttgtgtccgagcccacatccagcaccaccttgtctttaaagaggtggcggttgtgaaacatggagttgccgaagtgggcgtaggagtcaaagtagtaatctttggacgtcatgccctcgacgttcggcttctcgctgctttccgcctggccacaggacacctccatgatgcagttcacgacctcggcggccgccatcttcacccgcacctactcctcttccggccgccaagacccccgcctttttctatagtaggattttaagaggtgaaagaagcacagaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtg

SEQ ID NO: 160748 - DNA, 561 bp, Homo sapiens
  Payload ID: 11413
  Gene Symbol: NSD1
  Gene Name: nuclear receptor binding SET domain protein 1
  ENST ID: ENST00000508029
  CDS Start-End: 460-561
aaaacctcctctgggggagggagggagagagagaggaagggggagccccacaaccgtctaggaatgctcagcccctgggcccgtgcagggcgggagagccgggcctcagcacatcctgtagtctgtggagcaggacaggtcgcacagatggcccctgaaatctaggttgatggtgaagtcccggtcccagttcttggcgttgggccgcatgccgatggtgccgaagatctcctcgcccgtcttcaaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtg

SEQ ID NO: 160749 - DNA, 809 bp, Homo sapiens
  Payload ID: 11413
  Gene Symbol: NSD1
  Gene Name: nuclear receptor binding SET domain protein 1
  ENST ID: ENST00000511258
  CDS Start-End: 158-361
cgcgaacttcctcccggcgcggcccgtgccccgccggccgcctgcgaacacctcggcctccgcctcccctcaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatcatctacttcacaggaattgccatttagactggccttgtcatgttgcccaggctggcgtcgggactcctgggctcattcgatcctcctgcatcagctagaactacagtagtttcagattttgaagtgtgtatgtgtatgtgtgatatgtatatattccgtgtgtatagaaatggagagtatcttatttgagttgttgttttcagtaatgctgtcaagtattgttagagggtgataaatgataacatttgtttttatttgagcttatgaagaatttcttgactttctagctaaatgatcagttcacttctcttagcctcaattttattgcgtctaaattccagaagttcttgattgctataagattccttcagctttaaatattaatatttgatattgattttgtttctgcccaaacacattgtttggtcaccgccggtaatgttagcaaagagaattttttttggccaacaaatgtctcataccacattcagtttttataagaaaaacttttatggtatgttgttattctgagttcattaaacattcgctttacctta

SEQ ID NO: 160750 - DNA, 6952 bp, Homo sapiens
  Payload ID: 11414
  Gene Symbol: NCOA1
  Gene Name: nuclear receptor coactivator 1
  Uniprot ID: Q15788
  ENST ID: ENST00000288599
  CDS Start-End: 259-4458
ttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 160751 - DNA, 6895 bp, Homo sapiens
  Payload ID: 11414
  Gene Symbol: NCOA1
  Gene Name: nuclear receptor coactivator 1
  Uniprot ID: Q15788
  ENST ID: ENST00000348332
  CDS Start-End: 259-4584
ttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 160752 - DNA, 6828 bp, Homo sapiens
  Payload ID: 11414
  Gene Symbol: NCOA1
  Gene Name: nuclear receptor coactivator 1
  Uniprot ID: Q15788
  ENST ID: ENST00000395856
  CDS Start-End: 195-4517
ggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 160753 - DNA, 7405 bp, Homo sapiens
  Payload ID: 11414
  Gene Symbol: NCOA1
  Gene Name: nuclear receptor coactivator 1
  Uniprot ID: Q15788
  ENST ID: ENST00000405141
  CDS Start-End: 712-4911
gaatctcgcctgccgggaccgcgaaatgggggcgaccgcggcgtccctctccgtcggcgcagccctcgacggcgcttgggtttgaccccggcgcgcttgctcgccccttctcccgagaaggggtttcggaggagcagaggtttaataggcaagagaaagagaaaggaaaacagctctctctctaatgagagagaggggacttcggagaggaaaagaggacaggagatacggcaatcgtggataggaaaggaggaaattacgatagaaaagttggagatccttttgctaacacccctttgggcagttggatgctgagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctacaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 160754 - DNA, 4745 bp, Homo sapiens
  Payload ID: 11414
  Gene Symbol: NCOA1
  Gene Name: nuclear receptor coactivator 1
  ENST ID: ENST00000407230
  CDS Start-End: 667-4413
tggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccaggacaagaagacagaagagttcttctctgtggtgactacagactagaggaatgctctagtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaagg

SEQ ID NO: 160755 - DNA, 7289 bp, Homo sapiens
  Payload ID: 11414
  Gene Symbol: NCOA1
  Gene Name: nuclear receptor coactivator 1
  Uniprot ID: Q15788
  ENST ID: ENST00000406961
  CDS Start-End: 653-4978
gcggccgcctgcccggcgtggggagcgggcgccccgggccgccgccgagagggggagccggaagtcggcgcgggcgcccctcggccccgacgacgccgtgaccttggccggcccgctcacctctcggaatctcgcctgccgggaccgcgaaatgggggcgaccgcggcgtccctctccgtcggcgcagccctcgacggcgcttgggtttgaccccggcgcgcttgctcgccccttctcccgagaaggggtttcggagatctatccatactaatggaaatgtaactggaactgactctgatgataaaatcaaggaccatcaagcaagatcatgcagtaggcaactttgcttccaaaagaagttaccaacatttagaatttctacttattctgaggttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttcaacatgagtggcctcggggacagttcatccgaccctgctaacccagactcacataagaggaaaggatcgccatgtgacacactggcatcaagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaagagaaatcaacaactgatgacgatgtacagaaatcagacatctcatcaagtagtcaaggagtgatagaaaaggaatccttgggacctcttcttttggaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaagatttccagtcatgtctgatttgtattgcacggcgattacctcggcctccagctattacgggtgtagaatcctttatgaccaagcaagatactacaggtaaaatcatctctattgatactagttccctgagagctgctggcagaactggttgggaagatttagtgaggaagtgcatttatgcttttttccaacctcagggcagagaaccatcttatgccagacagctgttccaagaagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagattacctgagctggaattggaagcaattgataaccaatttggacaaccaggaacaggcgatcagattccatggacaaataatacagtgacagctataaatcagagtaaatcagaagaccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcagttgatacaccaaaatcggcaagctatcttaaaccagtttgcagcaactgctcctgttggcatcaatatgagatcaggcatgcaacagcaaattacacctcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaatgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcagataaatgatcccgcactgagacacacaggcctctactgcaaccagctctcatccactgaccttctcaaaacagaagcagatggaacccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaaa

SEQ ID NO: 160756 - DNA, 8447 bp, Homo sapiens
  Payload ID: 11415
  Gene Symbol: NCOA2
  Gene Name: nuclear receptor coactivator 2
  Uniprot ID: Q15596
  ENST ID: ENST00000452400
  CDS Start-End: 183-4577
agttattaacacgggaacatggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcatttgtgagttttatttgtacagttcctcatgaagttgcatctgagatgtgtgtatatgaaaagattatacaagggtaaaattaagcaatatattaactatggttcttcaggagaaagcttacagtgtttcaggttgtgatttattttcaaaatggagttgactctgaacatcactttgttcacctgcattgatgtttgtatttctagtgtgagcagtttatgcaaaggtagatatattcagagaaattttaaatacatttatgcaagttaatattgctttgctgatgctatttgcttatttgatgttaaataatgctattgtaaataaagaattctgttgttattgcatcatttaataaattttaatgccttcgggttttacatggctttagagattttaa

SEQ ID NO: 160757 - DNA, 1834 bp, Homo sapiens
  Payload ID: 11415
  Gene Symbol: NCOA2
  Gene Name: nuclear receptor coactivator 2
  ENST ID: ENST00000518363
  CDS Start-End: 1-1771
ggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcagaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtct

SEQ ID NO: 160758 - DNA, 6087 bp, Homo sapiens
  Payload ID: 11415
  Gene Symbol: NCOA2
  Gene Name: nuclear receptor coactivator 2
  ENST ID: ENST00000518287
  CDS Start-End: 343-3183
gagtcatggagacgctgagagccagctactcttgtccatccccgagtcacccgctccttgatttctggggttgtgtcacttataggggctccgacccgcagaggctgccgaggcactcgaggtcctgtatgtctttcgtaccgaaatagacgttgtcttagacacgacgaagtctaaagccactttaggatgtggcagtaactcaccgaggccggtttctaaaatggcatatgctgtagtgatcatgtcctggacctcagcgtccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcagaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatataggtaagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggtgagtgcccaaggagaagcaacccagtggcttcatatcacggctttttttctacttctgcatcaaatatatctttccataaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagac

SEQ ID NO: 160759 - DNA, 438 bp, Homo sapiens
  Payload ID: 11415
  Gene Symbol: NCOA2
  Gene Name: nuclear receptor coactivator 2
  ENST ID: ENST00000519724
  CDS Start-End: 389-438
agagcaagcaatagaatagaagcaggaagaattttcgagtgttccaccatgctggattgtcaaagggggatctgtctgatcagcagctaaaaaaggatttgtgtggctagtttgtcagctatcgttagaaacaaatgatagaggagataagcggcggggtgctcagcatgtgcttaggtttacatcaagatgtaatgttggtttgggttaacagaggagatttatctctgaggcaataaatttattgctaattgtgggggtttttgttttgatgagtgatgtatggtatttgtatttacatcactggtgaagataaagagaagctgctgagctctaatatgaactgcagaagctgtggacagttacaagttgctgatatgtgttcaagatgagtgggatgggagaaaatacctctgacccctccagggcagagacaag

SEQ ID NO: 160760 - DNA, 526 bp, Homo sapiens
  Payload ID: 11415
  Gene Symbol: NCOA2
  Gene Name: nuclear receptor coactivator 2
  ENST ID: ENST00000520416
  CDS Start-End: 502-526
ggagggggccggggtcgtcgctgccggctgcgctccccgcctcctcccctcgggggagtcccagaggcgcctcttccgagaccgggggtgggtcggtccctggttagatggcccctccctcttcccctccctctagtggtttccggggcctgcgggaccgaggggcgggaatcggggactggagcccccttccgctggcccggagctggactgggcctcccgcgttctgggtccgtcactggtaggggaaactttcccaaaccagagaccgagcctgaacaccttcctccgccacctcgtcctctaatcccactccctctccacctcctccgacgccttcccctcccaccgacccgaatctcggtgcgtctgactgatggggcagtgagccaatcgaaggcagggagctgacctgccgggtgtcgatttctcttggatttggctacacacttatagatcttctgcactgtttacaggcacagttgctgatatgtgttcaagatgagtgggatgggagaaaatacct

SEQ ID NO: 160761 - DNA, 6750 bp, Homo sapiens
  Payload ID: 11416
  Gene Symbol: NCOA3
  Gene Name: nuclear receptor coactivator 3
  Uniprot ID: Q9Y6Q9
  ENST ID: ENST00000371997
  CDS Start-End: 178-4425
gtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagttaccagtgatgggatattttccccaacagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttat

SEQ ID NO: 160762 - DNA, 4668 bp, Homo sapiens
  Payload ID: 11416
  Gene Symbol: NCOA3
  Gene Name: nuclear receptor coactivator 3
  Uniprot ID: Q9Y6Q9
  ENST ID: ENST00000371998
  CDS Start-End: 192-4466
ctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccaggtgagctcccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctc

SEQ ID NO: 160763 - DNA, 7939 bp, Homo sapiens
  Payload ID: 11416
  Gene Symbol: NCOA3
  Gene Name: nuclear receptor coactivator 3
  Uniprot ID: Q9Y6Q9
  ENST ID: ENST00000372004
  CDS Start-End: 217-4479
agccgctccacagcgacggcagcggctgcggcttagtcggtggcggccggcggcggctgcgggctgagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgataaagactccttaggaccgcttttacttcaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaagatttgcaatcttgtatgatctgtgtggcacgccgcattactacaggagaaagaacatttccatcaaaccctgagagctttattaccagacatgatctttcaggaaaggttgtcaatatagatacaaattcactgagatcctccatgaggcctggctttgaagatataatccgaaggtgtattcagagattttttagtctaaatgatgggcagtcatggtcccagaaacgtcactatcaagaagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagagggatctggagacttggataatctagatgctattcttggtgatctgactagttctgacttttacaataattccatatcctcaaatggtagtcatctggggactaagcaacaggtgtttcaaggaactaattctctgggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtgggccaaaccgaaatgtgactgtgactcagactccttcctcaggagactggggcttaccaaactcaaaggccggcagaatggaacctatgaattcaaactccatgggaagaccaggaggagattataatacttctttacccagacctgcactgggtggctctattcccacattgcctcttcggtctaatagcataccaggtgcgagaccagtattgcaacagcagcagcagatgcttcaaatgaggcctggtgaaatccccatgggaatgggggctaatccctatggccaagcagcagcatctaaccaactgggttcctggcccgatggcatgttgtccatggaacaagtttctcatggcactcaaaataggcctcttcttaggaattccctggatgatcttgttgggccaccttccaacctggaaggccagagtgacgaaagagcattattggaccagctgcacactcttctcagcaacacagatgccacaggcctggaagaaattgacagagctttgggcattcctgaacttgtcaatcagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcagtttttgaatcagagccgacaggcacttgaattgaaaatggaaaaccctactgctggtggtgctgcggtgatgaggcctatgatgcagccccagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaaaaatgaagtttattataagtttttatattttctacttgttcatttggtgcaaactcaagatttcttttaataggtgcagtctttgagataatttgtttttacctgtattgccctttatcttttttaggtaattctttgtactcctgctgtctacctctcctcacaccccagcaccccccattttttcaaaccttggtatctgttgggtgaacagtataatcttttcatctgcttttagaatgtgggatatttccagtacctactttttttttttttttttgctgaatccaaagatatataaataaaatatatatattttataaagatcagaatgatataaaggagatacatgtttcttcctttaaaaaataaacggaagttacattgttaatgttcatattatgatgccacttttctaaactgcatctggattgaaaggtgtaaatatcaataacagtgctacttagttatcagtatttaatatctgaggtgagttgggggtatctatattaggggtagggtattacagaagataattggcttgatgtcctagaagttctttgatccagaggtgggtgcagctgaaagtaaacagaatggattgccagttacatgtatgcctgcccagttccctttttatttgcagaagctgtgagttttgttcacaattaggttcctaggagcaaaacctcaaggattgatttattgttttcaactccaaggcacactgttaataaacgagcagggtgttttctctcttcctttctaatatatggagtttcgaagaataaaatatgagagcaatatttaaattctcaggaattgacttatactcttgagaatgaattcagtttcaatcaagtttacattatgttgcttaaaaaaatagaaattattctttatcttgcaaagaattgaaaccacatgaaatgacttatgggggatggtgagctgtgactgctttgctgaccattttggatgtcattgtaaataaaggtttctatttaaaattgga

SEQ ID NO: 160764 - DNA, 1755 bp, Homo sapiens
  Payload ID: 11417
  Gene Symbol: NCOA4
  Gene Name: nuclear receptor coactivator 4
  ENST ID: ENST00000580070
  CDS Start-End: 195-1541
tagtgtggggccgtgtctcagtccacccaaggtctcctcggatcgcctggagaggcactcggacctgactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagt

SEQ ID NO: 160765 - DNA, 3549 bp, Homo sapiens
  Payload ID: 11417
  Gene Symbol: NCOA4
  Gene Name: nuclear receptor coactivator 4
  Uniprot ID: Q13772
  ENST ID: ENST00000581486
  CDS Start-End: 204-2048
agagggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcc

SEQ ID NO: 160766 - DNA, 2124 bp, Homo sapiens
  Payload ID: 11417
  Gene Symbol: NCOA4
  Gene Name: nuclear receptor coactivator 4
  ENST ID: ENST00000585056
  CDS Start-End: 161-1705
aactctgcctttgggccgtaggttagtgtggggccgtgtctcagtccacccaaggtctcctcggatcgcctggagaggcactcggacctggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctc

SEQ ID NO: 160767 - DNA, 2307 bp, Homo sapiens
  Payload ID: 11417
  Gene Symbol: NCOA4
  Gene Name: nuclear receptor coactivator 4
  Uniprot ID: Q13772
  ENST ID: ENST00000578454
  CDS Start-End: 146-2098
ctttgggccgtaggttagtgtggggccgtgtctcagtccacccaaggtctcctcggatcgcctggagaggcactcggacctgttatgtctggacacattgcttcaacatagaacgcacatgaacaatgtggaggtctaggctggaatgggggcccagttgaccacttttgctctagctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacaggcatacttcaaaatgaactttcaagatgtaaccgttgggaattttcagatcccatgtggattctagtagtttatatacctacctcgaagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaaga

SEQ ID NO: 160768 - DNA, 2211 bp, Homo sapiens
  Payload ID: 11417
  Gene Symbol: NCOA4
  Gene Name: nuclear receptor coactivator 4
  Uniprot ID: Q13772
  ENST ID: ENST00000579039
  CDS Start-End: 154-2046
aactctgcctttgggccgtaggttagtgtggggccgtgtctcagtccacccaaggtctcctcggatcgcctggagaggcactcggacctgttatgtctggacacattgcttcaacatagaacgcacatgaacaatgtggaggtctaggctggaatgggggcccagttgaccacttttgctctagctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgag

SEQ ID NO: 160769 - DNA, 2371 bp, Homo sapiens
  Payload ID: 11417
  Gene Symbol: NCOA4
  Gene Name: nuclear receptor coactivator 4
  Uniprot ID: Q13772
  ENST ID: ENST00000583565
  CDS Start-End: 230-2074
attgattcaattttacactgtgccaggcattgtggcattccacacaaatggtgagaagctaaaagtgagaaatttggcacaggtgaagaaggctgggtaacacatttgaaagactgctaaacaggtcttgcatgactggcctaagtgcaaagtgaagcagcccatcacgctccagctctccaaatcggagccggcatttcacccatgtgatacaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctcca

SEQ ID NO: 160770 - DNA, 3489 bp, Homo sapiens
  Payload ID: 11417
  Gene Symbol: NCOA4
  Gene Name: nuclear receptor coactivator 4
  Uniprot ID: Q13772
  ENST ID: ENST00000585132
  CDS Start-End: 141-1985
ctggagttgccgtgtgacgcgtgggcgggacgaggcccgggctcggggacctttcgcactcgggtcaggggtaaagcagcctgtcgcttgccgggcagctggtgagtcggtgacctggcctgtgaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccata

SEQ ID NO: 160771 - DNA, 3220 bp, Homo sapiens
  Payload ID: 11418
  Gene Symbol: NCOA5
  Gene Name: nuclear receptor coactivator 5
  Uniprot ID: Q9HCD5
  ENST ID: ENST00000290231
  CDS Start-End: 166-1905
cggccgccattgcctcgtgcccgcgccggtcggttggtggcgcctttgtcctacggcgggcaggtgggccgacgcggaggcggcagcggcgggcctgaggcgaaggagcggccgggagcccgccgcgctggtagcgatattaataaggcagcggaaagaagaaatatgaatacggctccatcaagacccagccccacacgaagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaaagactatgctgagtctgtggggcggaaggtgcgagacctgggcatggtagtggacttgatcttccttaacacagaagtgtcactgtcacaagccttggaggatgttagcaggggaggttctccttttgctattgtcatcacccagcaacaccagattcaccgctcctgcacagtcaacatcatgtttggaaccccgcaagagcatcgcaacatgccccaagcagatgccatggtgctggtggccagaaattatgagcgttacaagaatgagtgccgggagaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaactacctgcgagagcggaaggagcggctgatgaggagcagcaccgactctctgcctggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgcctgcaactcctgcctagagttgaagaaaagcaaactggccttggcaggcacagtgtcatcataccctcaccccatatgtttggggtctgcttgaggattcataaatcagccactctggattgttgaggaatggccatggcagccacagaaaaaagaatttttctctctgagccaaggttgttttttgtttttttctcttttcttttttgttttcatttcattggaagatctccaatggactgaacagctccagtcagcagcagttaccacaaactgtgaatctgggccccaccactcttccctgttaaccagttctgtcagcatccccctctccagcagcacttccatgaagttggttctgagactctggccgtgaacacccgtttcttcagtgatttgttttgggcttttggctcaaaaccccaggctcttgtttttgtctagactcttattctgtttcctgagcagcaggaggtagggaccactttgatgtcagacttctggtagctggacatgttctcgagatgggtggctgttcgcgacttttgtaccagagtgaaattgttagaaggagggtttctggctgtggttctaaatggagccccaggaagctgccctctccccagggtttgtgctcagtagagccctgtggatcacagtcttgaggtcctctagcaggggtgagggagagcagcgacttcagctgagtccctgccagtggttaagcaaacaatggtttcaaaattcaaggtccccaaatggcagcattttatgttctgacctgtttgtgttatatagtggttttttttttcctctttggaactcttgtgttgttaataaaatgaaatgattactttttaattaaaatgaaaaaagtaaaa

SEQ ID NO: 160772 - DNA, 727 bp, Homo sapiens
  Payload ID: 11418
  Gene Symbol: NCOA5
  Gene Name: nuclear receptor coactivator 5
  ENST ID: ENST00000372291
  CDS Start-End: 414-727
cggccgccattgcctcgtgcccgcgccggtcggttggtggcgcctttgtcctacggcgggcaggtgggccgacgcggaggcggcagcggcgggcctgaggcgaaggagcggccgggagcccgccgcgctggtagcgggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggagagaaggctcttatgaccgatacctacgaatggatgactattgcaggagaaaggatgactcttattttgaccgttacagagatagctttgatggacggggccctccaggcccagaaagtcagtctcgtgcaaaagagcgtttgaaacgtgaggaacggcgtagagaagagctttatcgtcaatattttgaggaaatccagagacgctttgatgccgaaaggcccgttgattgttctgtgattgtggtcaacaaacagacaaa

SEQ ID NO: 160773 - DNA, 7081 bp, Homo sapiens
  Payload ID: 11419
  Gene Symbol: NCOA6
  Gene Name: nuclear receptor coactivator 6
  Uniprot ID: Q14686
  ENST ID: ENST00000359003
  CDS Start-End: 342-6533
ccccctccccgccggctccgtgaggccctgccgggtcgggctgcgggcggccgggcgcgggcggcgggacagacgggcgcacgcgaggactgacggacggacgcaccgagggcggcgggcacgcacggcccgggccggcgctccaaggcccgcccgggagggccggggccgcgctcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 160774 - DNA, 9311 bp, Homo sapiens
  Payload ID: 11419
  Gene Symbol: NCOA6
  Gene Name: nuclear receptor coactivator 6
  Uniprot ID: Q14686
  ENST ID: ENST00000374796
  CDS Start-End: 2572-8763
ctccagcccaggcaacagagcgtgactccgtctcaaaaaaaaaaaaaaaagtgaaaggaaaatgaggggagaattctcattgataataagggcgaaaaggtttttttggcagagtaatagagttttggaaaccattgcaaagctgtcaagtgtggtgtagtttttggttaaggaaatcagaggtgtcagcagacataaaagacaggggaaaacatgggaagtgtcctacctatagtgtagaaaaagcacaactatctatgtcagaggtcgacagactgtggtccataggtcaaatctggcccacgatctgtttttgtaaataacgttttattggaacatagccacactcatttatttatatattgtccatatcttcttttgtggtaccaatagcagagttgagtagtcgtgacagagatgtgttgtgtcagctcacaaagctggaaatactctttacaaaaacatttgccaacccctgatctatgtgtttgagtgttggatgttcaacctctaatttgccatccaatgtctatatgatgatagagaatgaataaacgtcttggctctgccctttgggctggattacccatgctctgtgtacctgcagcataacacagacccctgaatatttatatcagtcagtgatggcaaggtctattgttctggagtgtactgtgtggtaactgtggtagtgccagctttacacggattagataatgctcgggcttgttttgccattttttttattgggttgtcttttacaaaagatttatttatatattctgattattaatcctttgttgttggtagatattacagatgtcatttcccagtttcttgcttattttaatttttttttttttttttttgagatgaagtcttgctctgtcgcccaggctggagtgcagtcgtgccatctcagctcattgtaacctccgtctcccaggttcaagtgattctcttgcctcagcctcccaagtagctgggactacaggcatgtgccaccacacctggctgatttttgtgtttttagtagggatggggtttcatcatgttggccaggctggtctcaaactcctgacctcaagtgatccacccgtcttggcctcctaaagtgctgggattacaggtgtgagccactgcgcctggcctgttgcttattttaaaacatctgttttaaggtgtcatttgttaaaaagttctgaattttagtatcaactttatcaatcttttcctttaagatttgcagttattctttgttttgaggcagggtctcgctctgtcaccgaggctggagtgcagtggtgcgatctcggctcactgcagcctcaacctcctgggctcaagcaaccctcccacctcccatgccagttgagaccacaggcatgcgccaccatgccctgctactttttgcattttttgtagaggcggggtttcgccatgttgcccaggctagtctggaactcctgagctcaagcagtccacaaagtgctgggattacaggtgtgagctactgtgcccagcctgcaattattctttatattctggaatacctactgttgttttcaatggttagatctttaatgtatctggaatggattcttatgtgtagtgtaaggtcgggtccagtttcattttttttccctatgtataaccagtgatcccagcatcatttattgaatggggcttgctttcaaattgtgagctctttttggtggagtctgtctcaggtccttattaagcactgctgcttgctgattgtgtgaccttggacaaataaaacctcattgcgcctcagtctttaaggataatagtaatctcatagggttttgtgaggattaaatgagtcaatatacataacgtgtaaaacagtgcttggcacctagaacatgctcaataaatattagctgtactttagcactactgttcatttctgattcctcagcacctggtacagagcaggggctcattttgctcaattaaattgccaaattaatttggttttcaggtcaatcagaatggtgagagttgggctgagtgttgcaggagatgcttccaaggagctacttagttttaggggctgccttagattatctgctaggatagaactcttctcacgccatcacttttgcagagaacttctgtagcagaggttgcaaactggcaacctgtggttggatttgacctgtataagtattttgtttggtttacacaatatttttaatgtcttaaaaatgtacacagacctctgagtttctgacttaaccttgaaaaattggaagatctgtcaacagcaagcccatattcatttatagcggtaaccagctgaaacttttaggtcctgggaggaatggagaggggtcccactgactaacttttctgagagtggtcagagagttcttaagcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccaggttatccttctcaaccagttgaacagaggccacttcagcagatgcctcctcaactcatgcagcatgtggcacccccaccacagccaccacagcagcagccacagccacaactgcctcagcagcagcagccaccacctcccagtcagccacagtctcagcagcagcagcagcagcagcaacaaatgatgatgatgctcatgatgcagcaggatcccaaatcagttaggcttccagtctctcaaaatgtccatcctccaaggggccccctgaaccccgactcccagagaatgcccatgcaacagagtggcagtgtgcctgtcatggtcagtctgcaaggacctgcctccgtgccaccatcacctgataaacaaagaatgccaatgcctgtgaatactcccttgggaagcaattcaaggaaaatggtctatcaggagagcccgcagaatccttccagctcgccactggcggagatggcctcactccctgaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttctcatccccctgtgcagcaagtgaaagaattgaatccagatgaggctagccctcaggtgaacacctcagcagatcagaacactcttccctcttcacagtcaaccacaatggtttctccccttttgaccaatagtccagggtcctctggcaaccggcgaagcccagtctcgtctagtaagggcaaaggaaaagtggacaaaattggccaaattttgttgaccaaggcatgtaagaaagttacaggctctcttgagaaaggggaagaacaatatggtgcagatggagagactgaaggccaagggctagacaccacagctccggggctcatgggaacagagcagttatccacagagctggacagtaaaaccccaacgcccccagcacccactctgctaaaaatgacctctagccctgtgggcccgggcactgcctcagcaggacccagcttacctggcggtgctctccccaccagtgtacgctcgatagtaaccactctggtaccctccgagctcatctccgccgtaccgaccacaaaaagcaatcatggtggcatagcatctgagtcacttgcgggtggcctagtggaggagaaggtgggatcccatccagaacttctacccagcatagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggga

SEQ ID NO: 160775 - DNA, 4082 bp, Homo sapiens
  Payload ID: 11419
  Gene Symbol: NCOA6
  Gene Name: nuclear receptor coactivator 6
  ENST ID: ENST00000612493
  CDS Start-End: 323-3535
gtgaggccctgccgggtcgggctgcgggcggccgggcgcgggcggcgggacagacgggcgcacgcgaggactgacggacggacgcaccgagggcggcgggcacgcacggcccgggccggcgctccaaggcccgcccgggagggccggggccgcgctcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaaggg

SEQ ID NO: 160776 - DNA, 3271 bp, Homo sapiens
  Payload ID: 11419
  Gene Symbol: NCOA6
  Gene Name: nuclear receptor coactivator 6
  ENST ID: ENST00000616167
  CDS Start-End: 323-3271
gtgaggccctgccgggtcgggctgcgggcggccgggcgcgggcggcgggacagacgggcgcacgcgaggactgacggacggacgcaccgagggcggcgggcacgcacggcccgggccggcgctccaaggcccgcccgggagggccggggccgcgctcagaattttgatttggctgctgggctgctaccttgaaatccaagccctaaaaatgccagcttctttggacttagaagatgacctggataaatgataaaaattaagaaagagattttgaagttttcttattgtcctcttggcatatgcttctggaataatattcaccatggttttggatgaccttccaaacttagaagacatctatacttccttgtgttcatcaacaatggaagactcagagatggattttgactctggactagaagatgatgacacaaaaagtgatagtattttggaggattccacaatttttgtggccttcaaaggaaatatagatgataaagacttcaaatggaaattagatgcaatattgaaaaacgtgcccaatttgttacacatggagtccagcaagctaaaagtacagaaggtggagccctggaacagcgtgcgtgtgacattcaacatcccccgggaagcagcggagcggctacggatccttgctcagagcaacaaccagcagcttcgggatttagggattctctccgttcagattgaaggggaaggtgctattaacctggctttggctcagaaccgaagccaagatgtgagaatgaatggacccatgggagctggaaattcagttaggatggaggcgggatttcctatggcaagtggtccaggaataataaggatgaacaaccctgccactgttatgatacccccgggtggaaatgtgtcatcttccatgatggcaccaggccccaatccagagctgcagcccaggactcctcgccctgcttctcagtcagatgcaatggatccactcctctctgggctccatatacagcagcaaagtcatccctcaggatctttagctcccccacatcacccaatgcagcctgtctctgtgaacagacaaatgaacccagctaattttccccagctgcagcagcagcagcaacaacaacaacagcagcagcagcagcagcagcagcaacaacagcaacagcagcaacaacagttgcaggcaagacccccacagcaacatcagcagcaacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggaatgcctaaacgcctcccacctggcttctcagcaggacaggccaatccgaactttatgcaaggtcaggtgccttcgaccacagcaaccacccctgggaattcaggagcccctcagctgcaagcaaatcaaaatgtccagcatgcaggtggtcaaggagctggtcctcctcaaaaccagatgcaggtgtcccacgggccgccaaatatgatgcagcccagcctcatgggaattcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccagctaaaatgcttcgagtgcctaccactgagtggtaa

SEQ ID NO: 160777 - DNA, 660 bp, Homo sapiens
  Payload ID: 11419
  Gene Symbol: NCOA6
  Gene Name: nuclear receptor coactivator 6
  ENST ID: ENST00000628752
  CDS Start-End: 1-660
tccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaacaccccagatactcgcccagctggtctggaagaggctgatcagccaccgttgcctggagaacaaggaattaacttggataactcaggccctaaactgccagaattttcaaaccggccaccagccccgtcgcagaatttagtctcaaaggaaacttcaaccacagcactgcaggcctctgttgccagaccagagctggaggtaaatgctgccatagtctctggacaaagcagtgagcccaaagagatagttgaaaagtccaaaatcccaggccgaagaaactcccgaactgaagagccaactgtggcctctgaaagtgtggaaaatggacatcgtaaacgatcttctcgacctgcttcagcctccagctctactaaagctggtgctcccatgaaggaccaaatgctatgtgtggagagggccacaagaggaggacccaagagggacctctacaagctgagagttgagagtggtcccctgcc

SEQ ID NO: 160778 - DNA, 2998 bp, Homo sapiens
  Payload ID: 11420
  Gene Symbol: NCOA7
  Gene Name: nuclear receptor coactivator 7
  Uniprot ID: Q8NI08
  ENST ID: ENST00000229634
  CDS Start-End: 259-2742
gatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatcgcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacag

SEQ ID NO: 160779 - DNA, 5521 bp, Homo sapiens
  Payload ID: 11420
  Gene Symbol: NCOA7
  Gene Name: nuclear receptor coactivator 7
  Uniprot ID: Q8NI08
  ENST ID: ENST00000368357
  CDS Start-End: 353-3181
agaaaccctcataaagtagatgcagagggcagtaagatataactcaactttgaaaatgtcagccgttatagttgaagaaatctgacccaagagacttcgctccgctgcaagatggaaggaagcttaagtaagacataaatttgtaatgaacttgctcacaacatccgccgccactgtgacttgcagtcatcatccattaccacaaaattagttgcaggatggctactcgtatccctccacacatgatcatcagtatttgcctcctgtgtcccaaccggcctgagtcaaggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatctgacctacctcaggatctttgtcctctgtacaggcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggtttttttttttttaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcagtga

SEQ ID NO: 160780 - DNA, 6457 bp, Homo sapiens
  Payload ID: 11420
  Gene Symbol: NCOA7
  Gene Name: nuclear receptor coactivator 7
  Uniprot ID: Q8NI08
  ENST ID: ENST00000392477
  CDS Start-End: 370-3198
atgccctgacggggggcgcagctgcggggctggcgaggcgtcgcgcgtgggaagaggcctaagacaccccgactgcggcggctgcgcacacccgatccggacgcggggccccgcgggcgcgcgcctcggagctcccgcctcctcctcttgctcctcctcggcgtacggtcctcccctgacccctccttccacccgccgagaggatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcctgatgctgacttagcacgaaaggccttgaaacccattgaaagagtcttatcgtctacttctgaagaagatgagccaggtgtggtgaaatttttaaaaatgaattgtcgatacttcaccgatggaaagggtgtggttggcggtgttatgatagtgactcctaacaacatcatgtttgaccctcataaatctgatcctctggttattgaaaatgggtgtgaggagtatggtctcatctgccccatggaagaggttgtttccattgcgctctacaatgacatttctcacatgaagatcaaagatgccttgccatctgacctacctcaggatctttgtcctctgtacaggcctggagaatgggaagacctggcttcagaaaaggatatcaacccattcagtaagttcaaatctatcaacaaggaaaaacgacagcagaatggagagaaaattatgacttcggattccagaccaatagtacctttggagaagtccacaggacatacacctacaaagccctcaggcagctctgtgtcagagaaattaaagaaactggactcctctagggagacatcccatggttctcccacagtgactaagctcagcaaggaaccttccgacacttcttctgcatttgaatctacagccaaagaaaactttctaggggaagatgatgattttgttgacttggaagaactttcttctcaaactggtggtggaatgcacaaaaaagacaccttgaaggagtgcctttctcttgacccagaggaacgaaagaaagctgagtcacaaataaacaattctgccgtggaaatgcaggtgcagtcagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaagatatacttccttcaaaagaagaaaaaagcaagaccccacccatgttcctgtgcatcaaagtgggaaaaccaatgagaaaatcctttgccactcacactgcagccatggtccagcagtacggcaaacggagaaagcagccagagtactggtttgctgttcctcgggagagggtggatcatttgtacacattctttgttcagtggtctcccgatgtctatggaaaagatgccaaagagcaaggctttgtggtggtggagaaggaagaactgaacatgattgacaacttcttcagtgagccaacaaccaagagctgggagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggtttttttttttttaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcagtgattttctttcccaaagattcattcatcaggtatttactgggtaccagagtgtttatttttgtgagaggatggtgaaatatccaagactaaacaaggtccagagctcatgttttcactgctgccctggaaactccctcttcattccctgtagccaccctcctaattgtctcatcagttcacggaaactgctctcattatggttaccagagacaactcttggctgtatctaccagtctcttctaatctttctagctgtgcaatgaatgacaacctcctcctcttaacatctgtcttaacctacttcataatttccgtaagggacactttactctctgataaattttctttggcatcctgacacctagcccctagatgttgggctagatgaagaccccaagcagtcttcattgcttcataattcctcagttcataagtccatatcaaaggacttgggtgggaggaggcaaccaaatgtttcttcagactctactgaaaatgattagatgcatccccgtgctacaagccaccagagacatcctgcactattataagtatgtcttcccttaatttgatctccctctccttgatgccttttaaagttttagagacacattgatatggtttggctgtgtgtccccaccaacatctcattggaattataatccccacatgttgagggagggacctagtgggatgtgattagaacatgggggcggtttcccccatgctgttctcatgatagtgagggagttttcatgagatctgttttaaaatgtttggcagttccaccctcaccctctcttctgctgccatgtaagatgtgccttgcttcccctttgccttctgccatgattgtaaatttcctgacgcctacccagccatgtgaaactgtgagtccattaaacctcttttctttataa

SEQ ID NO: 160781 - DNA, 3133 bp, Homo sapiens
  Payload ID: 11420
  Gene Symbol: NCOA7
  Gene Name: nuclear receptor coactivator 7
  ENST ID: ENST00000438495
  CDS Start-End: 134-793
aatcatgcaggaaactagatactgagaaaacagttgtagctcagcgtggctacaagtaactgtggtgtggaagcagagtagagagaaaacttgttcctcattagagagagagccacacttctcactgctcacaatgagaggccaaagattacccttggacatccagattttctattgtgccagacctgacgaagagccttttgtgaagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggtctttaagtggagtggagaaaattcatactttatcaatggagacataagttctttagaacttggtggtggagggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggtttttttttttttaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcagtga

SEQ ID NO: 160782 - DNA, 581 bp, Homo sapiens
  Payload ID: 11420
  Gene Symbol: NCOA7
  Gene Name: nuclear receptor coactivator 7
  ENST ID: ENST00000453302
  CDS Start-End: 311-581
gacccctccttccacccgccgagaggatgcgctccccggcgcccagcagcagaggccaccgctcccagaaatgcatgcgaccgatccccttctcccggaccccaggagccggcgcccccgccctgtagattcccactctgtcgcccaggctggagtgcagtgatgtaatctcggctcactgcaacctccacttcccaggttcaagtgattctcctgcctcagcctccagagtagctgggattacagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattg

SEQ ID NO: 160783 - DNA, 765 bp, Homo sapiens
  Payload ID: 11420
  Gene Symbol: NCOA7
  Gene Name: nuclear receptor coactivator 7
  ENST ID: ENST00000417494
  CDS Start-End: 193-765
gacccctccttccacccgccgagaggatgcgctccccggcgcccagcagcagaggccaccgctcccagaaatgcatgcgaccgatccccttctcccggaccccaggagccggcgcccccgccctgtagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacactgctggaaaccaggacaccctaaactccatagcactgaaatttaacatcactcccaataaattggtggaactgaataaacttttcacacatactattgttccaggccaggtcctttttgtgccagatgccaactctccttccagtaccttaaggctatcatcatccagtcctggtgctactgtctctccttcatcatcagatgcagaatatgataaattgcct

SEQ ID NO: 160784 - DNA, 548 bp, Homo sapiens
  Payload ID: 11420
  Gene Symbol: NCOA7
  Gene Name: nuclear receptor coactivator 7
  ENST ID: ENST00000428318
  CDS Start-End: 278-548
agaatttgcaagttaagacacatgtacctagccactgggacagggaggtcattgaggacctccagctgtgtgacccacagctgtgtgggtcagtttggtgtagttaaggggtctctgctggttctgttcttttaaatggtgccatgtgtacaaacaaggaacacttttctgatgattcaaaaaatactttgtcttcatcacagctcttttgagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattg

SEQ ID NO: 160785 - DNA, 2978 bp, Homo sapiens
  Payload ID: 11420
  Gene Symbol: NCOA7
  Gene Name: nuclear receptor coactivator 7
  ENST ID: ENST00000444128
  CDS Start-End: 53-532
agagaaaacttgttcctcattagagagagagccacacttctcactgctcacaatgagaggccaaagattacccttggacatccagattttctattgtgccagacctgacgaagagccttttgtgaagatcatcactgttgaagaggcaaagcgcaggaagagcacatgcagctactatgaagacgaggacgaagaggtgctgcctgtcctacggccccacagcgcgctcctggagaatatgcacatcgagcagctggcccgacgccttcctgcaagggtgcaagggtatccatggagactggcctatagcacgttagagcacgggaccagcttaaagacgctctaccggaaatcggcatcactagacagtcctgtcctattggtcatcaaagatatggataatcagatttttggagcatatgcaactcatcctttcaagttcagtgaccactattatggcacaggcgaaacttttctctacacattcagccctcattttaaggggacgatttggtttatggctagatgctgatttataccacggacgaagcaactcttgcagcactttcaataatgatattctttccaaaaaggaagacttcatagttcaggatctggaggtgtgggcatttgattgaaattcagactgccttaaaatataacattaaaaagactgggttcgatcagccctcctaaagctggctggaaaaagaagccccagcccagcctgcctcatcccaccccaatgcttcctttctgccatcatctcagagcatgatcacattgcagaaagattctggaaggtccatgtagagggcagacattgaagaaagaaacttaaaatccaggttgttgaaaagactttgtactcccacttcctccaaatccatacagtgaggaatcagagtgtttatagatatatgagttgaatgcaatttttatttttggtaactgtgaaaaataagatactgtggatatatacatgccttgtgtatttatcagcataattttcattaccaaaatgtacagctattatttgccatggaaaaggttagtctcatttagaaaaatcgaaagtgcacagcacttaaagggaatatatgaggtttttttttttttaaaaaaaaacttttatttattatttgtagtatattgtctgaaatgtgtcggcagttttttttcttttaatgtgtcaaatcttgaaatattaaatgtatacattttgtgctatgttttgggaacaaatctgtttgatttatatagttttatattgaattttttttgccctgattgtttagggtgataggtcttaagcagcatatatctatatatctgtatgtgggtatatagagatatatgtgtgtgtgtatgtatatgtacatatacatatatatgagtgtataattctaaatttctaaaaactcattatgaatgttcatcaatttgactattataggccagctttccatttagtcaataaaagcgtacatttttagttacttaccttgaacatattcgtgtgaaaaagaatacatcatttctcacagtcttaagttgatatttatagaaatgaatacctttgtgaacctagacttagaacaaatcctgcttttgaaaaaaaatgttttgcttcttacaaaatcatttgtgttaataacaaaaactttattttcggagtgttctttgtataacttttccaagcttttacattaacgagcaggcctctgtcttaaaagggactcagtatattaatttctgcattttttaaatcaaatgaaaaacgtcaaattggaccaattgtcttggtttcttgattcatttatttgagaaaaaaacaatacaaagaaatgcattcatatcaaaattggaatagaaaggaaaacctatttttaagatatcaacctattttcacatcataaaacatctattacataaaataaaggtccaggcatagtggctcttgcctgtaatcccagcactttgggaggccgaggcaggtggatcactcaaggtcacaagtttgagaccagtctggccaacatggtgaaaccccatctctactaaaagtacaaatattagccgactatgtggcgggcacctgtaatcccacctactcgggaggctgaggcaggagaattgcttgaatccgggaagcagaggttgtagtgagccaagatcgtgccactgcactctatcctgggtaacagcgagactctgtcttaaaaataataacaataataataataataaagacttacttaaccaatattattgattaccagacttttatgaaagccaaagactgcttgctagtaggaaaaaatttcaaataataaccaaagctgaaaaatggtctgtcataaattatttccccggtaatttttgaaaggaaaaatgtataacaagtactatttacatatctgcatttaaaaaagcaattcttagaatacttcctttacattattctcctattttagacattttgtgaaagagaacaaattgtccagtggcctcctgtcagatcaacaattattatactccttaattccatgcaaatttaaatgaatgctataaaattttaaatctgtagcctgggtgtacgtttcactcaagttctcctactgaggactcttgactaacagcatactggcagtttcaccttaacctgctcgttaaataatgtgttggtgtgagatatcaggaatgtctcatgatatcacgtttaccatttacaccatctgcaaccatatgctattaataaaatggaaaaaaacaaaatggtcattttgcatatacttcactctgacctagtttagtccatgatactataattgtgagagcatatccagatgctgtgttctctatgtaaaacagtattgtccattcagaaatgtgtgacccttcatttatggatattgactatatgtaatgcagtgctatcccaatattttcaataaaggactttatgcattcagtga

SEQ ID NO: 160786 - DNA, 488 bp, Homo sapiens
  Payload ID: 11420
  Gene Symbol: NCOA7
  Gene Name: nuclear receptor coactivator 7
  ENST ID: ENST00000419660
  CDS Start-End: 138-488
actccattttatttttcacattggccagtgtaaacttttaagtttacagttgctttgttatcttttcttacagggttacgactcactgattaaaaagagggactttttcaaatactttgcacttttgattgtgtattatggataccaaggaagagaagaaggaacggaaacaaagttattttgctcgactgaaaaagaaaaaacaagccaaacaaaatgcagagacagcctcagctgtagctacaaggactcatactgggaaggaagataataatacagtagttttagagccagacaagtgcaacattgctgtggaagaggaatatatgactgatgagaaaaaaaagagaaaaagtaatcagttaaaggagatcaggcgtacagaactaaagagatattatagtattgatgacaatcaaaacaaaacacatgataaaaaagagaagaagatggtggttcagaagccccatgggactatggaatacact

SEQ ID NO: 160787 - DNA, 10720 bp, Homo sapiens
  Payload ID: 11421
  Gene Symbol: NCOR1
  Gene Name: nuclear receptor corepressor 1
  Uniprot ID: O75376
  ENST ID: ENST00000268712
  CDS Start-End: 259-7581
ggagggagaggggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtcaatcgactatgttatccgtaagacttctggtcagcagtaggccatgagtagttaagttttggaggagtcaaagttagatgtggatttttgactacttagggggtctatgcccctaactcctgcattatttgaaggtcaaccgtatagtttctgagaacatgtcagatcagagcctaacttcttactcttgcagttctacctgaggacccgaaggtgaggtgctgtgaaccactccctccatcctcatcataatgcatgtgcgtattactttatttaccatcacctggagaagaaatctcagaatgagagttaaaatccaataatagttcttggttcaaaataaatgaaaggacagaattctcacatggtttacctatggaggttcaccttatcatgatttaagtggtaagcacagagcagcactgacaacttactgtggttcactgcaaaccaaaacatgatattctttgtagacttagatttcagtgttctgacactatatccttacacgtgatttttttagcacccagaactaaattaaggtcttcctaatactcttcataaaagtattctgacagccagttttccactgcatgtttatgactgcaaatttcataatgcttttaattttggtacactgagtgattctattttaaaaatatttatgcccagaaaactccagtgaccattggacagttaaaaaattttaatgacacgattttaaccaattcacttttgaatttagaccaatcagtaaaggagatcagtcctccttttgcttcagtaccttattttacaacagtgtaaatgaactgtaatgaaaacacccacatgaagagactgtcctgaaaactcctagtgtttccaacaacgagaccatgagctgagtcactgtggatgatttaaaattaataaataaataaaacttggaatgaaaaa

SEQ ID NO: 160788 - DNA, 3106 bp, Homo sapiens
  Payload ID: 11421
  Gene Symbol: NCOR1
  Gene Name: nuclear receptor corepressor 1
  Uniprot ID: O75376
  ENST ID: ENST00000395848
  CDS Start-End: 71-2815
gtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaaggtaggtagatagagctatcaccaagagaacttttatgaagggaaataaagctaaacccaaaagcagtgtccattgtgctttgtaagttgtcagcctcccaactgattattatatttgtcctaacagacacagttccttaaattgaccttaaactatgaagaaatgttagtattattaactactaaaggatgccagtaacatttttaatagcattctagttaatgtgaattttctgatattcatctttgtgctggaagacattataaataaagttatgctttatgttccgttcatctgaa

SEQ ID NO: 160789 - DNA, 3419 bp, Homo sapiens
  Payload ID: 11421
  Gene Symbol: NCOR1
  Gene Name: nuclear receptor corepressor 1
  ENST ID: ENST00000395849
  CDS Start-End: 1-3215
tttcagtggagagcattccatccctacggggctctatcactcagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttga

SEQ ID NO: 160790 - DNA, 7950 bp, Homo sapiens
  Payload ID: 11421
  Gene Symbol: NCOR1
  Gene Name: nuclear receptor corepressor 1
  Uniprot ID: O75376
  ENST ID: ENST00000395851
  CDS Start-End: 45-7058
attggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagatatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccata

SEQ ID NO: 160791 - DNA, 9501 bp, Homo sapiens
  Payload ID: 11421
  Gene Symbol: NCOR1
  Gene Name: nuclear receptor corepressor 1
  ENST ID: ENST00000395857
  CDS Start-End: 270-7301
gcgggctggggggagggagaggggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgtttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgtggtttaaggctcctggtgtctcaggttccaaaggaaaagcttacatatttttcccttagtttgaatatatgattggttgggttaaaagataatgatctgtgtagtatttagataagctttatgctgcatcctgaaaaactcatggtgaacacagtcctttttccccatcactatggaccagcatttactctcactttgctcccttgggacaagagtttactgttaaatgttttcatttcacagagtctcaaggtgcaaataatttaaaagactgaattctaaactaattatggtactagagggccagttttatctttcattaagaattgcttgctgaattttaaagtttttttcatacaatttatcatagcatttaagtatctttctataacatagatactaacagttttgggagaatgccactggtaactggaaaggggagaaacagatctctcaggatgataaaaattagcactttacagactttcaagtagacctaaacttttaaacaaaagtactcaaggcttttaaggaagcagctctgtgattagctactgaccaagaccctcctatcactggtgtctaatccctatgttacagatgaagacacaggtttagtactttgcccatatagttaaattagtgacagagataggccataagcccacatttgtcttcagtcaaagctttcactcctgtccctgttccactcctgtatacctgaggtccccaacataaactttagatcaggcttagtggtcagcattcctagtacttggaaagttggtattttttacaacagatatatgtaaacatataaaaatttcaaaatgaatgaaaaacagtgactaaatgttccacttcacagttttctgctgaatttttttttttcaggtactggtaatattttagagtttgttaataatttatattgccaacctaccataaaagagattatgatggtatttttctatgaccctgagggtcttaagctattctgagtcagaatacagttgacccttgaacaacacgggtttgaactgtgtgggtccacttatacatggattttcttccacctctgccacccaagatagcaagaccaaccccttctcatcctcagcctattcaacatgaagatgacaaggatgaagaccttcatgatgatccacttccacttaatgaatagtaaatatattttctcttccttataatcttaacaaacattttctcttctctagcttactttattgtaagaatacagtatataatacatatacaaaatatgtgtc

SEQ ID NO: 160792 - DNA, 1969 bp, Homo sapiens
  Payload ID: 11421
  Gene Symbol: NCOR1
  Gene Name: nuclear receptor corepressor 1
  ENST ID: ENST00000436828
  CDS Start-End: 359-1969
caagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccgagtttcactcttgttgcccaggctggagtgcaatggcacgatctcggctcaccgcaacctctgcctcttgggttcaagcgattctcctgcctcagcctctcgagtagctgggattacaggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagactggagtacctgcaaggcgcatgatgaaaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaa

SEQ ID NO: 160793 - DNA, 274 bp, Homo sapiens
  Payload ID: 11421
  Gene Symbol: NCOR1
  Gene Name: nuclear receptor corepressor 1
  ENST ID: ENST00000436068
  CDS Start-End: 1-274
tagaagttctacaagtccatgtggcacatccaagagtccaaacagagagtgggaaggaaaatcagtcgcctatatgccttatgctgaggtcaaacgtgctctagaacaggaagcacagatgcacaatactgcagcaaggtcagcctcaccgtgtaggctttctccaagagaagtcagtaaagccgctccacagcctgatatgagtgcagcccgctatagtgtcccgccagtccttcagcctgctccacatcaagtgataactaatctccctgaa

SEQ ID NO: 160794 - DNA, 1883 bp, Homo sapiens
  Payload ID: 11421
  Gene Symbol: NCOR1
  Gene Name: nuclear receptor corepressor 1
  ENST ID: ENST00000411510
  CDS Start-End: 247-1883
gttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaa

SEQ ID NO: 160795 - DNA, 1204 bp, Homo sapiens
  Payload ID: 11421
  Gene Symbol: NCOR1
  Gene Name: nuclear receptor corepressor 1
  ENST ID: ENST00000430577
  CDS Start-End: 830-1204
tatactttgacatgccataaaattcacccattgtatgtgtacaattcaattacttcatttatacaactgttcaattatcaccatattccagcttaatggtcaatatttgctttgtcatttgatcttttctctatggtaagcaaaaatctattatttgaaaggttccttcactgaaagctgggtggagttgaactctaaaattacctacaaaattactttctatctagtcatctatgtctaattcttcaatttgacacatgcatgttactagcacaagctgcattttaaaggcagcaggaaggtcttttactatcattagaagttaaggagcaacatcgtggacaaatcggcctcgcccagcatttcagtgagggcttggtgcgaattccagccagagccctagaaagtatcttgggcaggtcgaaatgcacccctccagctcccagccacgaggggaccggcttccctgtacgcagctccggccagaggaggccgccgccgccccaccacgccgcggaggggtttgcagggtcccttccacggcctggagtttttccttttcccacgcctgaggaaggcctcgggcgcgcggaacagacgggcaggcggggggcgcacaagcccagggcacgatggcagcagcgctggatccggctgggcgctgctcggccccgtatccgtccgagaggaccgccgctgccaggcctagaggagacatgaagagaccgggcgcagcgcgacccgggaagctccgccgaggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcg

SEQ ID NO: 160796 - DNA, 549 bp, Homo sapiens
  Payload ID: 11421
  Gene Symbol: NCOR1
  Gene Name: nuclear receptor corepressor 1
  ENST ID: ENST00000579573
  CDS Start-End: 1-549
gaaaatacatcacccatggttaaatcaaagaagcaggagatttttcgtaagttgaactcctctggtggaggtgactctgatatggctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcag

SEQ ID NO: 160797 - DNA, 551 bp, Homo sapiens
  Payload ID: 11421
  Gene Symbol: NCOR1
  Gene Name: nuclear receptor corepressor 1
  ENST ID: ENST00000579606
  CDS Start-End: 1-551
tcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacg

SEQ ID NO: 160798 - DNA, 1877 bp, Homo sapiens
  Payload ID: 11421
  Gene Symbol: NCOR1
  Gene Name: nuclear receptor corepressor 1
  ENST ID: ENST00000582357
  CDS Start-End: 239-1877
aagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagactggagtacctgcaaggcgcatgatgaaaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcagcaaattgctcgaccctcgcaagaagaaaaagtagaagaaaaagaagaggataaagcagaaaaaacagaaaaaaaagaagaagaaaagaaagatgaagagg

SEQ ID NO: 160799 - DNA, 1848 bp, Homo sapiens
  Payload ID: 11421
  Gene Symbol: NCOR1
  Gene Name: nuclear receptor corepressor 1
  ENST ID: ENST00000460276
  CDS Start-End: 240-506
caagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacagtgtttattttctttgtatgtattaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaa

SEQ ID NO: 160800 - DNA, 650 bp, Homo sapiens
  Payload ID: 11421
  Gene Symbol: NCOR1
  Gene Name: nuclear receptor corepressor 1
  ENST ID: ENST00000580554
  CDS Start-End: 1-650
agattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttccagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgg

SEQ ID NO: 160801 - DNA, 247 bp, Homo sapiens
  Payload ID: 11421
  Gene Symbol: NCOR1
  Gene Name: nuclear receptor corepressor 1
  ENST ID: ENST00000603989
  CDS Start-End: 1-174
cgaagagaggaaggggacccatcacctcattcaggtacagctttcattttagtgcttttctgctgcttttccccaaaaaagccagtttatttcccaaattctgatgcatcactaagacatttcatttatgtctttatgtgctcagagtcacctcttagggtttccgttacttaaaaaaggtttttgaaaacctacccagacattataatatgaacagaaataaaatggaagaaaatttttacccaaa

SEQ ID NO: 160802 - DNA, 7226 bp, Homo sapiens
  Payload ID: 11422
  Gene Symbol: NCOR2
  Gene Name: nuclear receptor corepressor 2
  Uniprot ID: Q9Y618
  ENST ID: ENST00000356219
  CDS Start-End: 1-6240
ttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcc

SEQ ID NO: 160803 - DNA, 8533 bp, Homo sapiens
  Payload ID: 11422
  Gene Symbol: NCOR2
  Gene Name: nuclear receptor corepressor 2
  ENST ID: ENST00000405201
  CDS Start-End: 2-7546
catgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 160804 - DNA, 8520 bp, Homo sapiens
  Payload ID: 11422
  Gene Symbol: NCOR2
  Gene Name: nuclear receptor corepressor 2
  ENST ID: ENST00000404621
  CDS Start-End: 157-7533
gagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcca

SEQ ID NO: 160805 - DNA, 7175 bp, Homo sapiens
  Payload ID: 11422
  Gene Symbol: NCOR2
  Gene Name: nuclear receptor corepressor 2
  ENST ID: ENST00000404121
  CDS Start-End: 1-6189
ttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggtgaccccatcactcgcaggaccaagggggcggggactgctggctcacgccccgctgtgtcctccctccctcccttccttgggcagaatgaattcgatgcgtattctgtggccgccatctgcgcagggtggtggtattctgtcatttacacacgtcgttctaattaaaaagcgaattatactcc

SEQ ID NO: 160806 - DNA, 563 bp, Homo sapiens
  Payload ID: 11422
  Gene Symbol: NCOR2
  Gene Name: nuclear receptor corepressor 2
  ENST ID: ENST00000418829
  CDS Start-End: 1-389
cccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggtgggcaccaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcggggggggg

SEQ ID NO: 160807 - DNA, 467 bp, Homo sapiens
  Payload ID: 11422
  Gene Symbol: NCOR2
  Gene Name: nuclear receptor corepressor 2
  ENST ID: ENST00000440187
  CDS Start-End: 1-467
cgagtcctcgctggcactcaactacgctgcgggtccccgaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccc

SEQ ID NO: 160808 - DNA, 956 bp, Homo sapiens
  Payload ID: 11422
  Gene Symbol: NCOR2
  Gene Name: nuclear receptor corepressor 2
  ENST ID: ENST00000440337
  CDS Start-End: 1-404
cggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacagttttagtccacaagaagaaattttccaggctccagtctttgccactcaacctgtgtcagacttcacctttataaatggagatcgttaagcctggagccagctccatcaggtcacggactcgtggccttgggtagaaggcccagtcgcgctgctgtgatttcagcactcacccttgttggaaatgttgctttttcttcatgcacatggctgttttttcaaaagtgctgcagaaatgtggccaagacagcagaaaaggtgtgagcatccctggctacaaacgtatttgaaaccaaaagggaaaagaaaacgcaggcagccagcagttgctacagaaacgtgattttcaaagcatctgcatcacccgcaacctcatggaagcctcggtttggtttacaaaggagcgagtggtcggaaagacgatttgaccactttgtattcgtatgattcattcggagcagaagtttaaaactccatgaaacacttgccccgtggtgggcacggtggaatggggcttcactgggggcttttgaaagcaaaggctggtttaacaaaagttctgaaaagacagcacctctggggggtgtgcaaaggcccccacctccacgtggttcacaagaaagaaaaaa

SEQ ID NO: 160809 - DNA, 8475 bp, Homo sapiens
  Payload ID: 11422
  Gene Symbol: NCOR2
  Gene Name: nuclear receptor corepressor 2
  ENST ID: ENST00000429285
  CDS Start-End: 157-7671
gagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgcggccgctcaaggagggctccatcacgcagggcaccccgctcaagtacgacaccggcgcgtccaccactggctccaaaaagcacgacgtacgctccctcatcggcagccccggccggacgttcccacccgtgcacccgctggatgtgatggccgacgcccgggcactggaacgtgcctgctacgaggagagcctgaagagccggccagggaccgccagcagctcggggggctccattgcgcgcggcgccccggtcattgtgcctgagctgggtaagccgcggcagagccccctgacctatgaggaccacggggcaccctttgccggccacctcccacgaggttcgcccgtgaccacgcgggagcccacgccgcgcctgcaggagggcagcctttcgtccagcaaggcatcccaggaccgaaagctgacgtcgacgcctcgtgagatcgccaagtccccgcacagcaccgtgcccgagcaccacccacaccccatctcgccctatgagcacctgcttcggggcgtgagtggcgtggacctgtatcgcagccacatccccctggccttcgaccccacctccataccccgcggcatccctctggacgcagccgctgcctactacctgccccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcatcatcgacctgtcccaagtgccacacctgcctgtgctcgtgcccccgacaccaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctgaggtccacctccacctcctcacccgttcgcccggctgccacattcccacctgccacccactgcccactgggcggcaccctcgatggggtctaccctaccctcatggagcccgtcttgctgcccaaggaggccccccgggtcgcccggccagagcggccccgagcagacaccggccatgccttcctcgccaagcccccagcccgctccgggctggagcccgcctcctcccccagcaagggctcggagccccggcccctagtgcctcctgtctctggccacgccaccatcgcccgcacccctgcgaagaacctcgcacctcaccacgccagcccggacccgccggcgccacctgcctcggcctcggacccgcaccgggaaaagactcaaagtaaacccttttccatccaggaactggaactccgttctctgggttaccacggcagcagctacagccccgaaggggtggagcccgtcagccctgtgagctcacccagtctgacccacgacaaggggctccccaagcacctggaagagctcgacaagagccacctggagggggagctgcggcccaagcagccaggccccgtgaagcttggcggggaggccgcccacctcccacacctgcggccgctgcctgagagccagccctcgtccagcccgctgctccagaccgccccaggggtcaaaggtcaccagcgggtggtcaccctggcccagcacatcagtgaggtcatcacacaggactacacccggcaccacccacagcagctcagcgcacccctgcccgcccccctctactccttccctggggccagctgccccgtcctggacctccgccgcccacccagtgacctctacctcccgcccccggaccatggtgccccggcccgtggctccccccacagcgaagggggcaagaggtctccagagccaaacaagacgtcggtcttgggtggtggtgaggacggtattgaacctgtgtccccaccggagggcatgacggagccagggcactcccggagtgctgtgtacccgctgctgtaccgggatggggaacagacggagcccagcaggatgggctccaagtctccaggcaacaccagccagccgccagccttcttcagcaagctgaccgagagcaactccgccatggtcaagtccaagaagcaagagatcaacaagaagctgaacacccacaaccggaatgagcctgaatacaatatcagccagcctgggacggagatcttcaatatgcccgccatcaccggaacaggccttatgacctatagaagccaggcggtgcaggaacatgccagcaccaacatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagacactctccgacagcgagtgactcagaacagggcgggggggggggcggtgtcaggtcccagcgagccacaggaacggccctgcaggagcagggcggctgccgactcccccaaccaaggaaggagcccctgagtccgcctgcgcctccatccatctgtccgtccagagccggcatccttgcctgtctaaagccttaactaagactcccgccccgggctggccctgtgcagaccttactcaggggatgtttacctggtgctcgggaagggaggggaaggggccggggagggggcacggcaggcgtgtggcagccacacgcaggcggccagggcggccagggacccaaagcaggatgaccacgcacctccacgccactgcctcccccgaatgcatttggaaccaaagtctaaactgagctcgcagcccccgcgccctccctccgcctcccatcccgcttagcgctctggacagatggacgcaggccctgtccagcccccagtgcgctcgttccggtccccacagactgccccagccaacgagattgctggaaaccaagtcaggccaggtgggcggacaaaagggccaggtgcggcctggggggaacggatgctccgaggactggactgtttttttcacacatcgttgccgcagcggtgggaaggaaaggcagatgtaaatgatgtgttggtttacagggtatatttttgataccttcaatgaattaattcagatgttttacgcaaggaaggacttacccagtattactgctgctgtgcttttgatctctgcttaccgttcaagaggcgtgtgcaggccgacagtcggt

SEQ ID NO: 160810 - DNA, 674 bp, Homo sapiens
  Payload ID: 11422
  Gene Symbol: NCOR2
  Gene Name: nuclear receptor corepressor 2
  ENST ID: ENST00000453428
  CDS Start-End: 1-674
ccgacacctggcccccaaccccacctacccgcacctgtacccaccctacctcatccgcggctaccccgacacggcggcgctggagaaccggcagaccatcatcaatgactacatcacctcgcagcagatgcaccacaacgcggccaccgccatggcccagcgagctgatatgctgaggggcctctcgccccgcgagtcctcgctggcactcaactacgctgcgggtccccgaggcaccccagccaccgccatggaccgccttgcctacctccccaccgcgccccagcccttcagcagccgccacagcagctccccactctccccaggaggtccaacacacttgacaaaaccaaccaccacgtcctcgtccgagcgggagcgagaccgggatcgagagcgggaccgggatcgggagcgggaaaagtccatcctcacgtccaccacgacggtggagcacgcacccatctggagacctggtacagagcagagcagcggcagcagcggcgggggtgggggcagcagcagccgccccgcctcccactcccatgcccaccagcactcgcccatctcccctcggacccaggatgccctccagcagagacccagtgtgcttcacaacacaggcatgaagggtatcatcaccgctgtggagcccagcacgcccacggtcctga

SEQ ID NO: 160811 - DNA, 4675 bp, Homo sapiens
  Payload ID: 11422
  Gene Symbol: NCOR2
  Gene Name: nuclear receptor corepressor 2
  ENST ID: ENST00000458234
  CDS Start-End: 322-4675
gccggcgccctaggaggcggcggcgggaggatcgcgtcccgacccgaggccgggcctgctgcgcgcccccagcccgatcggcaccgccacttgcctgagcgccccggcggcccgagcgcgccccaagcccgggcgccaccgctgccacctccgcgaggtctccctgagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagccagcagcagcaacaacagcagcagcagcagcagcagcagcagcagcagcagcccatgccccgcagcagccaggaggagaaagatgagaaggagaaggaaaaggaggcggagaaggaggaggagaagccggaggtggagaacgacaaggaagacctcctcaaggagaagacagacgacacctcaggggaggacaacgacgagaaggaggctgtggcctccaaaggccgcaaaactgccaacagccagggaagacgcaaaggccgcatcacccgctcaatggctaatgaggccaacagcgaggaggccatcaccccccagcagagcgccgagctggcctccatggagctgaatgagagttctcgctggacagaagaagaaatggaaacagccaagaaaggtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccttacatgcctctgggaatgaggtgcccagaggggaatgcagtggcccagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacatcccggcccccactgagcccaccccggcctctgaagccaccggagcccctacgcccccaccagcacccccatcgccctctgcacctcctcctgtggtccccaaggaggagaaggaggaggagaccgcagcagcgcccccagtggaggagggggaggagcagaagccccccgcggctgaggagctggcagtggacacagggaaggccgaggagcccgtcaagagcgagtgcacggaggaagccgaggaggggccggccaagggcaaggacgcggaggccgctgaggccacggccgagggggcgctcaaggcagagaagaaggagggcgggagcggcagggccaccacagccaagagctcgggcgccccccaggacagcgactccagtgctacctgcagtgcagacgaggtggatgaggccgagggcggcgacaagaaccggctgctgtccccaaggcccagcctcctcaccccgactggcgacccccgggccaatgcctcaccccagaagccactggacctgaagcagctgaagcagcgagcggctgccatcccccccatccaggtcaccaaagtccatgagcccccccgggaggacgcagctcccaccaagccagctcccccagccccaccgccaccgcaaaacctgcagccggagagcgacgcccctcagcagcctggcagcagcccccggggcaagagcaggagcccggcaccccccgccgacaaggaggcagagaagcctgtgttcttcccagccttcgcagccgaggcccagaagctgcctggggaccccccttgctggacttccggcctgcccttccccgtgcccccccgtgaggtgatcaaggcctccccgcatgccccggacccctcagccttctcctacgctccacctggtcacccactgcccctgggcctccatgacactgcccggcccgtcctgccgcgcccacccaccatctccaacccgcctcccctcatctcctctgccaagcaccccagcgtcctcgagaggcaaataggtgccatctcccaaggaatgtcggtccagctccacgtcccgtactcagagcatgccaaggccccggtgggccctgtcaccatggggctgcccctgcccatggaccccaaaaagctggcacccttcagcggagtgaagcaggagcagctgtccccacggggccaggctgggccaccggagagcctgggggtgcccacagcccaggaggcgtccgtgctgagagggacagctctgggctcagttccgggcggaagcatcaccaaaggcattcccagcacacgggtgccctcggacagcgccatcacataccgcggctccatcacccacggcacgccagctgacgtcctgtacaagggcaccatcaccaggatcatcggcgaggacagcccgagtcgcttggaccgcggccgggaggacagcctgcccaagggccacgtcatctacgaaggcaagaagggccacgtcttgtcctatgagggtggcatgtctgtgacccagtgctccaaggaggacggcagaagcagctcaggacccccccatgagacggccgcccccaagcgcacctatgacatgatggagggccgcgtgggcagagccatctcctcagccagcatcgaaggtctcatgggccgtgccatcccgccggagcgacacagcccccaccacctcaaagagcagcaccacatccgcgggtccatcacacaagggatccctcggtcctacgtggaggcacaggaggactacctgcgtcgggaggccaagctcctaaagcgggagggcacgcctccgcccccaccgccctcacgggacctgaccgaggcctacaagacgcaggccctgggccccctgaagctgaagccggcccatgagggcctggtggccacggtgaaggaggcgggccgctccatccatgagatcccgcgcgaggagctgcggcacacgcccgagctgcccctggccccgc

SEQ ID NO: 160812 - DNA, 735 bp, Homo sapiens
  Payload ID: 11422
  Gene Symbol: NCOR2
  Gene Name: nuclear receptor corepressor 2
  ENST ID: ENST00000448008
  CDS Start-End: 1-735
caggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcag

SEQ ID NO: 160813 - DNA, 1752 bp, Homo sapiens
  Payload ID: 11422
  Gene Symbol: NCOR2
  Gene Name: nuclear receptor corepressor 2
  ENST ID: ENST00000420698
  CDS Start-End: 273-1752
ggtgtgcctcctggaagccggcagcacagcctgtgtgtgtggactctgctggcccgctggctggcactttttttctttttctttttttttcttgtgagagagttacttcaagttgtgtttggagctgacgtgagcgaggttggtcatgtgctcgggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggacgtcgggctcctggagtaccagcaccactcccgcgactatgcctcccacctgtcgcccggctccatcatccagccccagcggcggaggccctccctgctgtctgagttccagcccgggaatgaacggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagagcagggtgggccagcggggcagtgggctgtccatgtcggccgcccgcagcgagcacgaggtgtcagagatcatcgatggcctctcagagcaggagaacctggagaagcagatgcgccagctggccgtgatcccgcccatgctgtacgacgctgaccagcagcgcatcaagttcatcaacatgaacgggcttatggccgaccccatgaaggtgtacaaagaccgccaggtcatgaacatgtggagtgagcaggagaaggagaccttccgggagaagttcatgcagcatcccaagaactttggcctgatcgcatcattcctggagaggaagacagtggctgagtgcgtcctctattactacctgactaagaagaatgagaactataagagcctggtgagacggagctatcggcgccgcggcaagagcc

SEQ ID NO: 160814 - DNA, 532 bp, Homo sapiens
  Payload ID: 11422
  Gene Symbol: NCOR2
  Gene Name: nuclear receptor corepressor 2
  ENST ID: ENST00000413172
  CDS Start-End: 1-398
acatggggctggaggccataattagaaaggcactcatgggtaaatatgaccagtgggaagagtccccgccgctcagcgccaatgcttttaaccctctgaatgccagtgccagcctgcccgctgctatgcccataaccgctgctgacggacggagtgaccacacactcacctcgccaggtggcggcgggaaggccaaggtctctggcagacccagcagccgaaaagccaagtccccggccccgggcctggcatctggggaccggccaccctctgtctcctcagtgcactcggagggagactgcaaccgccggacgccgctcaccaaccgcgtgtgggaggacaggccctcgtccgcaggtgggcaccaggttccacgccattcccctacaaccccctgatcatgcggctgcaggcgggtgtcatggcttccccacccccaccgggcctccccgcgggcagcgggcccctcgctggcccccaccacgcctgggacgaggagcccaagccactgctctgctcgcagtacgagaca

SEQ ID NO: 160815 - DNA, 582 bp, Homo sapiens
  Payload ID: 11422
  Gene Symbol: NCOR2
  Gene Name: nuclear receptor corepressor 2
  ENST ID: ENST00000448614
  CDS Start-End: 95-582
agcagacgccaaccagcagcctcgcagagccgaccgcggccgcccagcctgccggcccacttcggcccgctccctggggcatcttcccagccctatgtttccggaaaacttggccgagggggagacgcgaatgagaggatgtctcctggaacacggccgcaactggtcggccatcgcccggatggtgggctccaagactgtgtcgcagtgtaagaacttctacttcaactacaagaagaggcagaacctcgatgagatcttgcagcagcacaagctgaagatggagaaggagaggaacgcgcggaggaagaagaagaaagcgccggcggcggccagcgaggaggctgcattcccgcccgtggtggaggatgaggagatggaggcgtcgggcgtgagcggaaatgaggaggagatggtggaggaggctgaagccactgtcaacaacagctcagacaccgagagcatcccctctcctcacactgaggccgccaaggacacagggcagaatgggcccaagcccccagccaccctgggcgccgacgggccacccccagggccacccaccccaccaccggaggacat

SEQ ID NO: 160816 - DNA, 828 bp, Homo sapiens
  Payload ID: 11422
  Gene Symbol: NCOR2
  Gene Name: nuclear receptor corepressor 2
  ENST ID: ENST00000542927
  CDS Start-End: 1-827
ggtcccaggagctccacctgcggccagagtcccactcatacctgcccgagctggggaagtcagagatggagttcattgaaagcaagcgccctcggctagagctgctgcctgaccccctgctgcgaccgtcacccctgctggccacgggccagcctgcgggatctgaagacctcaccaaggaccgtagcctgacgggcaagctggaaccggtgtctccccccagccccccgcacactgaccctgagctggagctggtgccgccacggctgtccaaggaggagctgatccagaacatggaccgcgtggaccgagagatcaccatggtagagcagcagatctctaagctgaagaagaagcagcaacagctggaggaggaggctgccaagccgcccgagcctgagaagcccgtgtcaccgccgcccatcgagtcgaagcaccgcagcctggtgcagatcatctacgacgagaaccggaagaaggctgaagctgcacatcggattctggaaggcctggggccccaggtggagctgccgctgtacaaccagccctccgacacccggcagtatcatgagaacatcaaaataaaccaggcgatgcggaagaagctaatcttgtacttcaagaggaggaatcacgctcggaaacaatgggagcagaagttctgccagcgctatgaccagctcatggaggcctgggagaagaaggtggagcgcatcgagaacaacccccggcggcgggccaaggagagcaaggtgcgcgagtactacgagaagcagttccctgagatccgcaagcagcgcgagctgcaggagcgcatgcagaggtgag

SEQ ID NO: 160817 - DNA, 7556 bp, Homo sapiens
  Payload ID: 11423
  Gene Symbol: NRIP1
  Gene Name: nuclear receptor interacting protein 1
  Uniprot ID: P48552
  ENST ID: ENST00000318948
  CDS Start-End: 599-4075
gcaggcgccttcgcggaccgagcctgacggagccggaggctgggagccgcggcggcctggggaagtgtttggattgtgagctatttcagaactgttctcaggactcattattttaacatttgggagaaacacagccagaagatgcacacttgactgaaggaggacagggaatctgaagactccggatgacatcagagctacttttcaacagccttctcaattttctttctcagaaagcagaggctcagagcttggagacagacgaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtc

SEQ ID NO: 160818 - DNA, 7562 bp, Homo sapiens
  Payload ID: 11423
  Gene Symbol: NRIP1
  Gene Name: nuclear receptor interacting protein 1
  Uniprot ID: P48552
  ENST ID: ENST00000400199
  CDS Start-End: 605-4081
cgacccggccccacgcccgcccgccacccgcgcgcgcccgtccgcccgtggcctcgcgtccgccgctgcgccgtgagcgccgctggtcggagggaagagctcgccggggcgccgggccaggacggggcggcaggcgccttcgcggaccgagcctgacggagccggaggctgggagccgcggcggcctggggaagtgtttggattgtgagctatttcagaactgttctcaggactcattattttaacatttgggagaaacacagccagaagaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtc

SEQ ID NO: 160819 - DNA, 7671 bp, Homo sapiens
  Payload ID: 11423
  Gene Symbol: NRIP1
  Gene Name: nuclear receptor interacting protein 1
  Uniprot ID: P48552
  ENST ID: ENST00000400202
  CDS Start-End: 714-4190
agacattgcagcagagccccgaactcgggaggcggcggcggaggaggcggcggcgaggcgcagggacgacccggccccacgcccgcccgccacccgcgcgcgcccgtccgcccgtggcctcgcgtccgccgctgcgccgtgagcgccgctggtcggagggaagagctcgccggggcgccgggccaggacggggcggcaggcgccttcgcggaccgagcctgacggagccggaggctgggagccgcggcggcctgggatgcacacttgactgaaggaggacagggaatctgaagactccggatgacatcagagctacttttcaacagccttctcaattttctttctcagaaagcagaggctcagagcttggagacagacgaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatgtctttggaaatcgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcattgtc

SEQ ID NO: 160820 - DNA, 720 bp, Homo sapiens
  Payload ID: 11423
  Gene Symbol: NRIP1
  Gene Name: nuclear receptor interacting protein 1
  ENST ID: ENST00000411932
  CDS Start-End: 524-720
ttgtggttatctcagcagaagacataccgccctcctccttgtattggtcgggacctgggcattagggagtcaaggcaaaggagaaagaaaagagattttacattagtattctatgaaagccttacggtctgcagaacaaattgattactccggtgtacctgtgcttggcaccactgctgtgagagaaagaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtcc

SEQ ID NO: 160821 - DNA, 2746 bp, Homo sapiens
  Payload ID: 11424
  Gene Symbol: NRIP2
  Gene Name: nuclear receptor interacting protein 2
  Uniprot ID: Q9BQI9
  ENST ID: ENST00000337508
  CDS Start-End: 42-887
agcaatctcgggaaattggagactgacgcggctgctcctgcatgttatttatttttcctctttccctcccgtggagaccctcctgttggaaagagagctgcagcacgggacagagacaggcaggaagaagcagagaggactcggtgacgcccccaccgagcagcccctggcccactcctccagcaggggccatgagcaccaagcaggaggccaggagagatgagggagaagccaggacgagggggcaggaggcacagcttcgagaccgagcccacctgagccagcagcgccggctcaaacaggccacccagttcctgcacaaggactcggccgacctgctcccgctggacagcctcaagaggctcggcacctccaaggacttgcagccgcgcagtgtgatccaaagacgcctggtggagggaaacccgaattggcttcagggggagcctccccggatgcaggacctgattcatggccaggagagcaggaggaagaccagcaggacagagattccagctcttctggtcaactgcaagtgccaggaccagctgcttagagtggccgttgacacaggcacccaatacaatcggatctctgctggatgtctcagccgcctggggttagagaaaagggtcctaaaagcctcagctggggacctggcccctgggcccccaacccaggtggagcagttggagctacagctggggcaggagactgtggtgtgctcggcacaggtggtggatgctgagagtcctgaattctgcctgggcctgcagactctgctttctctcaagtgctgcatcgacctggagcacggagtgctgcggctgaaagccccgttctcagagctacccttcctgcctttgtaccaagagcctggccagtgactgctgtctcagtcagtccccagagggaaagaccttgccttagaagaagaggcgtgtggggaacgggggctcttgaagccaggtagctggggactatggtgtctgcccttccaatcacctccctgacccctgctgtcccattttccccagctggccgcattcctctctgcttctcagcagctgtcctactccccaggacgagttttcactagagggcccacgatgccaggattctgattcatcttcctcccaagaaaagcaaagccaaatcaagaccacagataggaacctaagcacaatggggtgcctgcttgggctgggtcgaaggctctgctgactgctgtccttgtccatcacccaataccaccccaaacacaactcaacttcccacaccaccatgtctctcaccacaccttctgggcctcattatctcccacaactagaccgccatgcctcaccaacctatgtccctggacctcctggtgtctgcctctcggagtctgtgcacatctgctcacagttgagtgggggaagaaacagccagaattcaatacaacaaagagcgggagttagtataggaatgtccatctcataaggctgagagctattttttcctgtggctgcaaatgtctgaagccagttagtttgattaccctgtgcaaaaccttggacatacttctgctattaacgctataggtatttatccgtttccactggctttttgtacccaccgagcccctgagccttgcgtgtgtgtgtgtggaagagccttgtagagaactgctcctgtgaggcagacaggacagtgaggttgtcaccactcagacttcacctattcagcattctttctgatttctagaactatccacctcattaggccttcttcctatccccatctctggcctcttgagcttaagcttgtattgtcctggaatcagtggctttctaaccccctgccaggctttgccaaagcaaaaagacagaggctttttttttttttttaaagtttggggtctgtcaggagacagaggcttttttgaattcactgtgaagagaagaacccgaaccttaagacgccagatccctgagagtctttctggctggtttgagtctctcaaatcatggattaggagtaaagaaagaggccaggcgcaatggctcatgcctgtaatcccagcactttgggaggctgaggtgggtggatcacttgaggtcaggagtttgagaccagcctgggtaatatggcaaaaccccatctctactaaaaaatacaaaaattagccaggtatggtggtgaacacctgtaatcccagctacttggaaggctgaggcataggagttgcttgaacctgggagatgggggttgtagtgagccaagttcgtgccatcggactccagcctgggtgaaggagtgagaccctgtctccaaaaacaaacaaaaaaggagcagagaaagacagtggtacagctaacctgaacaagggaactgggaccgttgggctgaaacagtcttgagcctggggttgactgggttagagaagaaccgggatgcaaggagctgcctgtgacacctggcctgccctttctcagctgcctcccctgccctttctcagctgcctcccctgccctcagaaggaaaggagagggctcacttatcacttgtgccatagcacctggtctcaaaatcctaaaagctttcctcgccctcactgccttgctccacaaggtccactttcctgggtcttgtgctgtgcctttccttgtctgcctcctgctgcttctgtaactgcagaccccaggcccaatggcaagccctcggctcagctgcttctccattggaataaactcttgtttctcta

SEQ ID NO: 160822 - DNA, 578 bp, Homo sapiens
  Payload ID: 11424
  Gene Symbol: NRIP2
  Gene Name: nuclear receptor interacting protein 2
  ENST ID: ENST00000542386
  CDS Start-End: 165-578
agttaaagactctgacatctgctaggcgggaggcaagagacctaacaagaccctcctgttggaaagagagctgcagcacgggacagagacaggcaggaagaagcagagaggactcggtgacgcccccaccgagcagcccctggcccactcctccagcaggggccatgagcaccaagcaggaggccaggagagatgagggagaagccaggacgagggggcaggaggcacagcttcgagaccgagcccacctgagccagcagcgccggctcaaacaggccacccagttcctgcacaaggactcggccgacctgctcccgctggacagcctcaagaggctcggcacctccaaggacttgcagccgcgcagtgtgatccaaagacgcctggtggagggaaacccgaattggcttcagggggagcctccccggatgcaggacctgattcatggccaggagagcaggaggaagaccagcaggacagagattccagctcttctggtcaactgcaagtgccaggaccagctgcttagagtggccgttgacacaggcacccaatacaatcggatctctgctggatgt

SEQ ID NO: 160823 - DNA, 591 bp, Homo sapiens
  Payload ID: 11424
  Gene Symbol: NRIP2
  Gene Name: nuclear receptor interacting protein 2
  ENST ID: ENST00000542990
  CDS Start-End: 66-591
agtcaattagttaaagactctgacatctgctaggcgggaggcaagagacctaacaagcaggggccatgagcaccaagcaggaggccaggagagatgagggagaagccaggacgagggggcaggaggcacagcttcgagaccgagcccacctgagccagcagcgccggctcaaacaggccacccagttcctgcacaaggactcggccgacctgctcccgctggacagcctcaagaggctcggcacctccaaggacttgcagccgcgcagtgtgatccaaagacgcctggtggagggaaacccgaattggcttcagggggagcctccccggatgcaggacctgattcatggccaggagagcaggaggaagaccagcaggacagagattccagctcttctggtcaactgcaagtgccaggaccagctgcttagagtggccgttgacacaggcacccaatacaatcggatctctgctggatgtctcagccgcctggggttagagaaaagggtcctaaaagcctcagctggggacctggcccctgggcccccaacccaggtggagcagttggagctacagctggggcaggagactg

SEQ ID NO: 160824 - DNA, 3809 bp, Homo sapiens
  Payload ID: 11425
  Gene Symbol: NRIP3
  Gene Name: nuclear receptor interacting protein 3
  Uniprot ID: Q9NQ35
  ENST ID: ENST00000309166
  CDS Start-End: 115-840
gcgacgtcacgctcggctataaaaggcgcggctcggggcccttgcggcgctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatgcaacctcataatattctgcagaggcgcctcatggaaaccaacctgtctaagctccgaagcggtccccgtgtcccttgggcctctaagacgaacaaactcaatcaggctaagtctgaggggctaaagaagtctgaggaggatgacatgattttggtttcttgccagtgtgctggaaaggatgtgaaagccttggttgacacaggctgcctatataatctcatctctttggcctgtgtggacagattgggactcaaggagcatgtcaaatcccacaagcatgaaggagaaaagctttctctaccccggcatctcaaagtagtgggccagattgagcacctagtgatcacactgggctccctccgcctggactgcccagcagctgtggttgatgacaatgagaaaaacttgtcccttggtctacagactctccgatctctgaagtgcatcataaacttggataagcaccggctgatcatggggaagacagacaaggaagaaatcccttttgtggagacagtctctttgaatgaagacaacacttcagaagcataactacagcctgcagcatgtctgcacgtgtgcatgcatacacaccgggttgacagatagagaaaactgggtttgaaccaaatgccgtagtgacttgctgtggaccaagtccttccatctaatagaagctccaggggctccttcccattcagacctctctagactatagtctatgcttagagatcttgtctggttatggccattgttttttactactttgatcacttaacttatagaccttttttgacactgccagtctcacttgtggcctatttctctgcttcttccaggaatttgcttttattagtcaagtataggggctgccaggttctgtgtctccatagatatatgtgcttcttttcctatagctaaatgtataataaacaggaacctgacctttacctcctttcagctgtttcaaacaggtgccaggatacctatgtcttagaattagagtttcttcaaattgattcattgatttctcaagtatggattatgtgaaagagcccagggacattatccattacagtttaactctttcatttaaaggtccagagaggcaagtgaattgtctaagttcatatattaggtcagtgactgaagggaccaagaacgcagacctgatttccaagccaagactcccatgctgcctcatttgtattcaagcctttaacaggagggcaaagaggtgagaatgtgttaaaaaaaaaaaaaaaaaggcagagcatgggaggaatattctctggagatggatgctaggatgatttgggtagctctccctcctgtgtgccaagcccagtaaaagttccttgccccaaactgtcacatttaggccctcatcttggtgcctaaaaacgagcgtacaaagatgaatgaaatggtttctcactgtgaacctcttggaggaaaggaggaaccacagacagaggaatattaatccctctctgatatggaattgaaggcttaagtaaatcagagtgtcactgtcagacgttgattactcccaagatccgatcagcatttctgcccatcctattatgtgtctgtcaaggactgaagtagctggaaaccaggagtagagaaagatggggggaaaaaaagagcaaggccagaatagaagggagtagactgagtagaatcagttggtggagaggcctatctagataaacctttctgggaggcagggaatgacattttcaggcagggaattgagatgttcagttctgtcctgatacaaggaaagaggcagagcaggagccggcaatgttaaggacaactttttataactgcccagtatttcctgacccctgtcaaaggttggggagaatacaaggtttcttgaagctttttgactggggtgtcacattaggcacacaggtgtctataatggaatctccccttcagtttggtcatagaagtgcttggacaagtcagaaaaatagctagctgtgggtatccctttaagatattcccaagtctaccctgtgtcatagcagtagttctcagagtgtttgtttaaaggatcccactttgaactttgccaagtactaccaactaccttgtctggtgttcagcaactgcccctactgaacagccctttggaactctgaatgatttgggcctcacagaagctccctaaagcctaggaacttggtgactatcatttgaacaactaggcagccatactgcagtcagttgtcatggggtcattccctaggcccccttcctatcagcctctacctaaagaagctagataggaagctaagcacagccatggttgggaggctatatctaaagctcatgaggggtgatcccggggttaccagccttcagcactccctctagcaacaccccattctcttacctagcggggatttgtacctttccactgaggcctctccatgctccttccctacctttcatggcaatactttggcctgcctcttatcctggtactaagttgaagtaaagctcaccctttacttccctacttgaaagttctactctgagccttgactcttagccacagtgaggcatgttgaaggttcctgctggtttattctttttttttttttttttttagacagagtctcactctgttgcccaggctggagtgcagtggcacgatctcggttcactgcaagctccgcctcccgggttcatgccattctcctgcctcagcctcccaagtagctgggactacaggcacctgccaccacgcctggctaattttttgtatttttagtagagacgggtttcaccgtgttagctaggatggtctcgatctcctgaccttgtggtccgcccacctcagcctcccaaagtgctgggattacaggcgtgagccaccgcacccggccttcattcactttctttaaatgcctccaagttgattattctcctagctcatatctccttgatgtgcatgagggagcactgggtctaatttttgggggctgagaaggtaagaaggtgaggtcagtttttcccaggagtcctaaaaaattctggtaccttacattgagggtgtgggagaaagggtgtcatagttctgaaaataggcagtagcatgaagcaccagacctgtctcattccttattagatgtctatctcaaataacagagtttgaaaaatattggttttatcatttgatatttccatgcctgactcgggaaaataacattttctgacttctttctattttcttgccctgcacagaccctacctggtacaattttctatttcttagctcaaagtgtctatacaatgggttgcctggtatgtcagctgccctcactcttgtgtaatagaaatatattgccaggctggggacgtggaggagacgaactggattcctccctcctcctgttgccaggcctctctgcattggcactttatcctttcagtgtttctggctgtgttgggttcatttgtgagactgatgtaacaataaagtgaaatcttcccctctg

SEQ ID NO: 160825 - DNA, 551 bp, Homo sapiens
  Payload ID: 11425
  Gene Symbol: NRIP3
  Gene Name: nuclear receptor interacting protein 3
  ENST ID: ENST00000531142
  CDS Start-End: 1-198
atcacactgggctccctccgcctggactgcccagcagctgtggttgatgacaatgagaaaaacttgtcccttggtctacagactctccgatctctgaagtgcatcataaacttggataagcaccggctgatcatggggaagacagacaaggaagaaatcccttttgtggagacagtctctttgaatgaagacaagtgagtgcccaaatgggtcagatcaagtcacatccatttgtcatcagctgcgagcagggtggtggtggttctcagacaggacatggggttgtatcctgtctttggctttcaattatactacaaatccacccttccccacacccagagttcatcaccccacaaaactctgtagtgcacacatcagaatgagcaatggtgatgccacacagagtggtagggaaatgactagctttgaaagcaaaattttacttgccttcagcttaactttttttgaatttggcattatttctcctgatatttatttctcatttcagcacttcagaagcataactacagcctgcagcatgtctgcacgtg

SEQ ID NO: 160826 - DNA, 980 bp, Homo sapiens
  Payload ID: 11425
  Gene Symbol: NRIP3
  Gene Name: nuclear receptor interacting protein 3
  ENST ID: ENST00000531090
  CDS Start-End: 115-540
gcgacgtcacgctcggctataaaaggcgcggctcggggcccttgcggcgctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatgcaacctcataatattctgcagaggcgcctcatggaaaccaacctgtctaagctccgaagcggtccccgtgtcccttgggcctctaagacgaacaaactcaatcaggctaagtctgaggggctaaagaagtctgaggaggatgacatgattttggtttcttgccagtgtgctggaaaggatgtgaaagccttggttgacacaggctgcctatataatctcatctctttggcctgtgtggacagattgggatgacaatgagaaaaacttgtcccttggtctacagactctccgatctctgaagtgcatcataaacttggataagcaccggctgatcatggggaagacagacaaggaagaaatcccttttgtggagacagtctctttgaatgaagacaagtgagtgcccaaatgggtcagatcaagtcacatccatttgtcatcagctgcgagcagggtggtggtggttctcagacaggacatggggttgtatcctgtctttggctttcaattatactacaaatccacccttccccacacccagagttcatcaccccacaaaactctgtagtgcacacatcagaatgagcaatggtgatgccacacagagtggtagggaaatgactagctttgaaagcaaaattttacttgccttcagcttaactttttttgaatttggcattatttctcctgat

SEQ ID NO: 160827 - DNA, 547 bp, Homo sapiens
  Payload ID: 11425
  Gene Symbol: NRIP3
  Gene Name: nuclear receptor interacting protein 3
  ENST ID: ENST00000525100
  CDS Start-End: 67-547
gctggaggagctcgaggctgaggctgccggggggctgtgggctaccgggccgccggcgcctcagcgatgttttactcagggctcctcactgagggcggccgcaaggagaccgacatgcgggaggcggcgtcactgcgacagcagcgccggatgaagcaggcggtgcagttcatccacaaggactccgccgacctgctgcccctggacggcctcaagaagctgggctcgtccaaggacatgaggcgcctcatggaaaccaacctgtctaagctccgaagcggtccccgtgtcccttgggcctctaagacgaacaaactcaatcaggctaagtctgaggggctaaagaagtctgaggaggatgacatgattttggtttcttgccagtgtgctggaaaggatgtgaaagccttggttgacacaggctgcctatataatctcatctctttggcctgtgtggacagattgggactcaaggagcatgtcaaatcccacaagcatgaaggagaaaagctttctctaccccggcatctcaaagtagtgggccaga

SEQ ID NO: 160828 - DNA, 567 bp, Homo sapiens
  Payload ID: 11425
  Gene Symbol: NRIP3
  Gene Name: nuclear receptor interacting protein 3
  ENST ID: ENST00000534759
  CDS Start-End: 1-167
cccttggtctacagactctccgatctctgaagtgcatcataaacttggataagcaccggctgatcatggggaagacagacaaggaagaaatcccttttgtggagacagtctctttgaatgaagacaagtccagagaggcaagtgaattgtctaagttcatatattaggtcagtgactgaagggaccaagaacgcagacctgatttccaagccaagactcccatgctgcctcatttgtattcaagcctttaacaggagggcaaagaggtgagaatgtgttaaaaaaaaaaaaaaaaaggcagagcatgggaggaatattctctggagatggatgctaggatgatttgggtagctctccctcctgtgtgccaagcccagtaaaagttccttgccccaaactgtcacatttaggccctcatcttggtgcctaaaaacgagcgtacaaagatgaatgaaatggtttctcactgtgaacctcttggaggaaaggaggaaccacagacagaggaatattaatccctctctgatatggaattgaaggcttaagtaaatcagagtgtcactgtca

SEQ ID NO: 160829 - DNA, 475 bp, Homo sapiens
  Payload ID: 11426
  Gene Symbol: NR0B1
  Gene Name: nuclear receptor subfamily 0, group B, member 1
  ENST ID: ENST00000378963
  CDS Start-End: 11-328
gtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccgggaaaagggaaggaaaatgattgcaatcatcattaacatcatttaaaccaagtggtcaactgctaattacttgaatacaagttaaagaactttgcaacgatattatcatcatggaagatcaaaggaccttcaaaagcagcctcctcttattactttccttataaaaacttacatccacttaaa

SEQ ID NO: 160830 - DNA, 2021 bp, Homo sapiens
  Payload ID: 11426
  Gene Symbol: NR0B1
  Gene Name: nuclear receptor subfamily 0, group B, member 1
  Uniprot ID: P51843
  ENST ID: ENST00000378970
  CDS Start-End: 236-1648
gagctcccacgctgctgttcttccatttccagcttttaaagagcacccgccccttcgaaccaccgaggtcatgggcgaacacaccggagcgcagcaccgcgcccccccgcacacaccgcccgcctccgcgcccttgcccagaccgaggcggccgacgcgcctgcgtgcgcgctaggtataaataggtcccaggaggcagccactgggcagaactgggctacgggcgccgcgggccatggcgggcgagaaccaccagtggcagggcagcatcctctacaacatgcttatgagcgcgaagcaaacgcgcgcggctcctgaggctccagagacgcggctggtggatcagtgctggggctgttcgtgcggcgatgagcccggggtgggcagagaggggctgctgggcgggcggaacgtggcgctcctgtaccgctgctgcttttgcggtaaagaccacccacggcagggcagcatcctctacagcatgctgacgagcgcaaagcaaacgtacgcggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggctccggcagcgcccgaggcacggccagggggcgcgtggtgggaccgctcctacttcgcgcagaggccagggggtaaagaggcgctaccaggcgggcgggccacggcgcttctgtaccgctgctgcttttgcggtgaagaccacccgcagcagggcagcaccctctactgcgtgcccacgagcacaaatcaagcgcaggcggctccggaggagcggccgagggccccctggtgggacacctcctctggtgcgctgcggccggtggcgctcaagagtccacaggtggtctgcgaggcagcctcagcgggcctgttgaagacgctgcgcttcgtcaagtacttgccctgcttccaggtgctgcccctggaccagcagctggtgctggtgcgcaactgctgggcgtccctgctcatgcttgagctggcccaggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaatgctggagtctgaacatcagtaccaaggagtacgcctacctcaaggggaccgtgctctttaacccggacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggcccatcatcggcacagtcagcatggatgatatgatgctggaaatgctctgtacaaagatataaagtcatgtgggccacacaagtgcagtagtgcagttcaccatgagggaagaataaagagctgtgggcaaaagagtgtaaaatattttaaaataaactttcttaatatttttacatgcagagtatttttgtattcaattaaagaaataattttattccagacagtcacaaatttctctgttccatagttaaagaagacatttgccaacaggtagcatagctctgtacatcttttaaaaaaaaaatagcagggtactagtataataagctattttcacaagtgtagcaatttcatggaacctgctcaaatcaaatttgtacatattgttataataaattttaaggtcttaactattaacttgattgaaaaaagctt

SEQ ID NO: 160831 - DNA, 1156 bp, Homo sapiens
  Payload ID: 11427
  Gene Symbol: NR0B2
  Gene Name: nuclear receptor subfamily 0, group B, member 2
  Uniprot ID: Q15466
  ENST ID: ENST00000254227
  CDS Start-End: 27-800
ctggaagtgagagcagatccctaaccatgagcaccagccaaccaggggcctgcccatgccagggagctgcaagccgccccgccattctctacgcacttctgagctccagcctcaaggctgtcccccgaccccgtagccgctgcctatgtaggcagcaccggcccgtccagctatgtgcacctcatcgcacctgccgggaggccttggatgttctggccaagacagtggccttcctcaggaacctgccatccttctggcagctgcctccccaggaccagcggcggctgctgcagggttgctggggccccctcttcctgcttgggttggcccaagatgctgtgacctttgaggtggctgaggccccggtgcccagcatactcaagaagattctgctggaggagcccagcagcagtggaggcagtggccaactgccagacagaccccagccctccctggctgcggtgcagtggcttcaatgctgtctggagtccttctggagcctggagcttagccccaaggaatatgcctgcctgaaagggaccatcctcttcaaccccgatgtgccaggcctccaagccgcctcccacattgggcacctgcagcaggaggctcactgggtgctgtgtgaagtcctggaaccctggtgcccagcagcccaaggccgcctgacccgtgtcctcctcacggcctccaccctcaagtccattccgaccagcctgcttggggacctcttctttcgccctatcattggagatgttgacatcgctggccttcttggggacatgcttttgctcaggtgacctgttccagcccaggcagagatcaggtgggcagaggctggcagtgctgattcagcctggccatccccagaggtgacccaatgctcctggagggggcaagcctgtatagacagcacttggctccttaggaacagctcttcactcagccacaccccacattggacttccttggtttggacacagtgttccagctgcctgggaggcttttggtggtccccacagcctctgggccaagactcctgtcccttcttgggatgagaatgaaagcttaggctgcttattggaccagaagtcctatcgactttatacagaactgaattaagttattgatttttgtaataaaaggtatgaaacac

SEQ ID NO: 160832 - DNA, 2772 bp, Homo sapiens
  Payload ID: 11428
  Gene Symbol: NR1D1
  Gene Name: nuclear receptor subfamily 1, group D, member 1
  Uniprot ID: P20393
  ENST ID: ENST00000246672
  CDS Start-End: 632-2476
gggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctgagctggc

SEQ ID NO: 160833 - DNA, 5258 bp, Homo sapiens
  Payload ID: 11429
  Gene Symbol: NR1D2
  Gene Name: nuclear receptor subfamily 1, group D, member 2
  Uniprot ID: Q14995
  ENST ID: ENST00000312521
  CDS Start-End: 320-2059
gtcacatggtcgcggctgccctccccgtcagccgccctcgccgccgcggtgcgctggctgcaggaagccgccgcgccgccgcttttgttgtcagggacccagcgaggagcgccgctcgccggccgccgccaccctctctcgctgcagcctgctgtgcgctgcacggcctggggcccgggagccccgcccgctctgcccatgagggggccccgcgaccaccgctgcttccagcccggggcggcgcggcgctgaggcggcggcggcggcgctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctggtttgtccaatgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttcatctgccaaaaccaaaaaccattttgatctccctgtggttatcaatataacgcacaatcacaagtgtatgaggacttagaaattaatcctttgtggtaggagttctgttgaatgatggaaatcttattactaccacaagactatttgatctggtaattggagacttcgggatttaggagatctccatgtctgtatttactctaccactgctaaagtgtgtggtcctgggtagtttacttgcttgcggaaaatgagaattgatggtgtccccaatgccccacctcacagagttactaaaaaatgtctgtaaagcatatttacctcttgggagataggcactatgtaaataaggtaaaatttctgttattacaattattcataataatattcttttcttatttctaagcctttctgggaaatcatttcagtccacaccaaccatattattcagggttcctgccatatgtgtggggtatcctactgatacacacgtattcaaagtttatgggtacaacaaagacatagtacatgtacataatatgtatgtgaatatagttaaatatatttcttcacaatattttaaactgtgaagaactttatcatacaggaaacttaaaacaagaggtgtcaaaagacccaaattaggtgcattttacttgtttatgatggcataaccattgctttaaaatgtttagacagtagaatattgaatttatgctctatttttgtttatttaagcaacacttaatgtaaaagtgcaacaggcaattgaatccaaatttcaacgacaaaaaaaaaaaacatgtattttagagttcatctttggcaaaatctttggttcagggtactagttgtttaaaagttgattcatattcttaccttgtgctgagaaaggttgcattgctgccccttatacacatgctgcagcttgatgttaaagaatttttattctttctgaagaactaattaatgtttaaagcaactgtttaatatgatggcatgtgtgtgtgtgcgtgcgtgtgtatgttctgagtccacttcttttttcctaaataacactacagggattttgtcatattagatttaatttataatttgaaaaatcatctagtgtgtgacctacaggcttagaaatggtatagtcaaagacattttatccacatttctaatagtggacttgattaagtagataagatcagcatctgtttatggtagtaggagaaatagccaaagttgaggattttatgtatgttttcctgtttacctggaaaatagcaattaattggattttttggtaaagattgccttctgtataatgtttggattatataaaattgcaaaaatgataacagcccgctttactgtactaagcctgttactttcatgacgtgtgagcagaatgccttattttgtaatcttgtttaacttgttgctactgggacttgatttactgtggcactagttaagtaagttaaaaaaaagttaaaccctctcattattaaagaggaaaggcgatggtgatgtctgtagtacaatataaaccataattgtgatttaccttaagtaggtataactcttatgggatatacagtatagtttttgtgaatctttacatgatagcattatctttttataattttttttcctaagataaacaaatgcatagttttcttctatgggtgatagaaacagctttttgaagtaatgaaaacctcaaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaacttctgagttggtgggacactgttgattaataatgtactgtatgaattaagtgatgctttaactttgattttacattttaaagttaaaatgtgggcattatgtcagcaaacttaagggcattatgtcagcaagctaaaacattttttttcctgtgcttttaatgtatctctttacatgatctgagagaggattcaagttgatagaaatagctgaggggaaaagggggaacatcttgggatgaagcttgtccttatggtgatggtttaattacagattaaaaaattagaaggaaatttcagtggattaagtgtatagctttcatatctacatttcaagaaattaccattgtaacttgataagagatgatttattttatgtaaacatctttgcaaagcaaggtgtagcagctcagctagatttattactgtgcacgaaagtaaatacctatctcaattattctttttcttttccaatataaagtttgctgaatgtacaagaagagtttatcacttaggatatagaatttttttaggggttgggggaggggatctgttaggaaactgttacctataaacaaagattgactggattcgatccaaaagataaaacttgaagctattctggaactaacatggaaaaatgaaatggctattgtttaaaaaaatgatagaaatacattgttgatgggatatgagttaagtttattttctacaaactgtaattgatgaggacatggataatatcttcatgtttctgagaagtaatctgtatgtggggggaggggataataaatatttctaaccaac

SEQ ID NO: 160834 - DNA, 3129 bp, Homo sapiens
  Payload ID: 11429
  Gene Symbol: NR1D2
  Gene Name: nuclear receptor subfamily 1, group D, member 2
  ENST ID: ENST00000383773
  CDS Start-End: 205-1431
tcgccggccgccgccaccctctctcgctgcagcctgctgtgcgctgcacggcctggggcccgggagccccgcccgctctgcccatgagggggccccgcgaccaccgctgcttccagcccggggcggcgcggcgctgaggcggcggcggcggcgctgccccctctgcgggaagcgggcggccccggccgcctccgcgagggcaccatggaggtgaatgcaggaggtgtgattgcctatatcagttcttccagctcagcctcaagccctgcctcttgtcacagtgagggttctgagaatagtttccagtcctcctcctcttctgttccatcttctccaaatagctctaattctgataccaatggtaatcccaagaatggtgatctcgccaatattgaaggcatcttgaagaatgatcgaatagattgttctatgaaaacaagcaaatcgagtgcacctgggatgacaaaaagtcatagtggtgtgacaaaatttagtggcatggttctactgtgtaaagtctgtggggatgtggcgtcaggattccactatggagttcatgcttgcgaaggctgtaagggtttctttcggagaagtattcaacaaaacatccagtacaagaagtgcctgaagaatgaaaactgttctataatgagaatgaataggaacagatgtcagcaatgtcgcttcaaaaagtgtctgtctgttggaatgtcaagagatgctgttcggtttggtcgtattcctaagcgtgaaaaacagaggatgctaattgaaatgcaaagtgcaatgaagaccatgatgaacagccagttcagtggtcacttgcaaaatgacacattagtagaacatcatgaacagacagccttgccagcccaggaacagctgcgacccaagccccaactggagcaagaaaacatcaaaagctcttctcctccatcttctgattttgcaaaggaagaagtgattggcatggtgaccagagctcacaaggatacctttatgtataatcaagagcagcaagaaaactcagctgagagcatgcagccccagagaggagaacggattcccaagaacatggagcaatataatttaaatcatgatcattgcggcaatgggcttagcagccattttccctgtagtgagagccagcagcatctcaatggacagttcaaagggaggaatataatgcattacccaaatggtcatgccatttgtattgcaaatggacattgtatgaacttctccaatgcttatactcaaagagtatgtgatagagttccgatagatggattttctcagaatgagaacaagaatagttacctgtgcaacactggaggaagaatgcatctgtacagtgttcatattcagccaaaatttcaccaaaaacagcagtaccacaccatttccagtttaaaccatgaagtcctttgatagtgcttggtattttctactgacaggtttgtccaatgagtaagtctccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagatcgatctggaatagaaaacgtcaactctgtggaggctttgcaggaaactctcattcgtgcactaaggaccttaataatgaaaaaccatccaaatgaggcctctatttttacaaaactgcttctaaagttgccagatcttcgatctttaaacaacatgcactctgaggagctcttggcctttaaagttcacccttaaggcctttgtttatttaaacatgaactgatggtaactgtacattttgtgctaaaatgcatatttatatgtgtataccatatgtggagatagaaaagacctttaagacaataaaagattgtaggctatctctgtaatcatgcaatagctgttcggattgagaactcttcagccatgattagacgttgactgcatctccctgatagaccaatcagctgtgtcgcacttaaactggagaagttacactgaagtataatcacactgaatgttagactttttcatctgccaaaaccaaaaaccattttgatctccctgtggttatcaatataacgcacaatcacaagtgtatgaggacttagaaattaatcctttgtggtaggagttctgttgaatgatggaaatcttattactaccacaagactatttgatctggtaattggagacttcgggatttaggagatctccatgtctgtatttactctaccactgctaaagtgtgtggtcctgggtagtttacttgcttgcggaaaatgagaattgatggtgtccccaatgccccacctcacagagttactaaaaaatgtctgtaaagcatatttacctcttgggagataggcactatgtaaataaggtaaaatttctgttattacaattattcataataatattcttttcttatttctaagcctttctgggaaatcatttcagtccacaccaaccatattattcagggttcctgccatatgtgtggggtatcctactgatacacacgtattcaaagtttatgggtacaacaaagacatagtacatgtacataatatgtatgtgaatatagttaaatatatttcttcacaatattttaaactgtgaagaactttatcatacaggaaacttaaaacaagaggtgtcaaaagacccaaattaggtgcattttacttgtttatgatggcataaccattgctttaaaatgtttagacagtagaatattgaatttatgctctatttttgtttatttaagcaacacttaatgtaaaagtgcaacaggcaattgaatccaaatttcaacgacaaaaaaaaaaaa

SEQ ID NO: 160835 - DNA, 1998 bp, Homo sapiens
  Payload ID: 11430
  Gene Symbol: NR1H2
  Gene Name: nuclear receptor subfamily 1, group H, member 2
  Uniprot ID: P55055
  ENST ID: ENST00000253727
  CDS Start-End: 236-1618
cggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttatttaataaaaactaaaaacagaaa

SEQ ID NO: 160836 - DNA, 1466 bp, Homo sapiens
  Payload ID: 11430
  Gene Symbol: NR1H2
  Gene Name: nuclear receptor subfamily 1, group H, member 2
  Uniprot ID: P55055
  ENST ID: ENST00000411902
  CDS Start-End: 246-1337
gacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactggggcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatccctt

SEQ ID NO: 160837 - DNA, 856 bp, Homo sapiens
  Payload ID: 11430
  Gene Symbol: NR1H2
  Gene Name: nuclear receptor subfamily 1, group H, member 2
  ENST ID: ENST00000597157
  CDS Start-End: 173-856
gagggtttgtaggctggcaggaaccagggttgtggctgagagtagggtctttggagagatggaaaaaaaagggaaagccctgtcaggacctgtaactgacctaacctaacccttcttagccccacaaggctctcaatcccctgtattctacaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccag

SEQ ID NO: 160838 - DNA, 718 bp, Homo sapiens
  Payload ID: 11430
  Gene Symbol: NR1H2
  Gene Name: nuclear receptor subfamily 1, group H, member 2
  ENST ID: ENST00000597790
  CDS Start-End: 374-718
gttgccggaagaagtggcgaagttacttttgagggtatttgagtagcggcggtgtgtcaggggctaaagaggaggacgaagaaaagcagagcaagggaacccaggtaggtgcacccgagagtggggagacgcaggaggagccccgaacccggggcttctcggcgctccccgcgtactccgctctgcccccttctctccttccatttcctcccctcggtaattcgcgcctcccgcggctgtttccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtg

SEQ ID NO: 160839 - DNA, 1828 bp, Homo sapiens
  Payload ID: 11430
  Gene Symbol: NR1H2
  Gene Name: nuclear receptor subfamily 1, group H, member 2
  Uniprot ID: P55055
  ENST ID: ENST00000593926
  CDS Start-End: 104-1486
ggaggtggggggaaactacatggcatggaggccgtgaaggcagagcatgattaaaggagaatgggccctacctagaaaaagcaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctc

SEQ ID NO: 160840 - DNA, 1915 bp, Homo sapiens
  Payload ID: 11430
  Gene Symbol: NR1H2
  Gene Name: nuclear receptor subfamily 1, group H, member 2
  ENST ID: ENST00000598168
  CDS Start-End: 247-1539
tgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacggagatcgtggacttcgctaagcaagtgcctggtttcctgcagctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttatttaataaaaactaaaaaca

SEQ ID NO: 160841 - DNA, 894 bp, Homo sapiens
  Payload ID: 11430
  Gene Symbol: NR1H2
  Gene Name: nuclear receptor subfamily 1, group H, member 2
  ENST ID: ENST00000597130
  CDS Start-End: 266-894
gttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagagccccacaaggctctcaatcccctgtattctacaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccaggg

SEQ ID NO: 160842 - DNA, 2380 bp, Homo sapiens
  Payload ID: 11430
  Gene Symbol: NR1H2
  Gene Name: nuclear receptor subfamily 1, group H, member 2
  ENST ID: ENST00000593532
  CDS Start-End: 880-1410
agatgagactgcatggggcgggaactagagatggaggactttcccgcgcaagggggacaggctggactgaaagaggacacgggaagaacaaagacttagactcgaagccctcggatggtggcccttgcatgcttcagttcatgatgttggagactatttccccacccttgcggaaaaaccttctctctgtgccatgcagctactgccagggatggaggatggcgggaattggcaactaaagactgtcctcctaccctcttcagtgtgtccttcagcaatatgaagttaaaaccagtcttgctctgtccccaggctggagtgcagtggcacgatcttggctcactgcaacctccgcctcacgggttccagcgattctcctgcctcagtctcctgagtagctgggactacaggctcagagaagcgcatgaatgagctaaagccacaaagcgcggggctggaggtttggctcccaagaagcgaggaaatgggttcggaactcttctgccaagtcccagtagatctacccggtaaacttccggtgagtttccaacttccgtgcggggcagcagcttcggctggtcctaagcggaccggaagttcgtcaagtttcacgctccgcccctcttccggacgtgacgcaagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctctgcttttatttaataaaaactaaaaacag

SEQ ID NO: 160843 - DNA, 1830 bp, Homo sapiens
  Payload ID: 11430
  Gene Symbol: NR1H2
  Gene Name: nuclear receptor subfamily 1, group H, member 2
  ENST ID: ENST00000599105
  CDS Start-End: 232-1482
gttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccgggggtccggaccctgatgtcccaggcactgatgaggccagctcagcctgcagcacagactgggtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgcgtcctttctgaagaacagatccggaagaagaagattcggaaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacgctgggccgggaggaccagatcgccctcctgaaggcatccactatcgagatcatgctgctagagacagccaggcgctacaaccacgagacagagtgtatcaccttcttgaaggacttcacctacagcaaggacgacttccaccgtgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccagggccttcctcttcctc

SEQ ID NO: 160844 - DNA, 507 bp, Homo sapiens
  Payload ID: 11430
  Gene Symbol: NR1H2
  Gene Name: nuclear receptor subfamily 1, group H, member 2
  ENST ID: ENST00000600355
  CDS Start-End: 386-507
gcttggaagagacagggccgcagaaagtagaaacggtccagatgagactgcatggggcgggaactagagatggaggactttcccgcgcaagggggacaggctggactgaaagaggacacgggaagaacaaagacttagactcgtcttgctctgtccccaggctggagtgcagtggcacgatcttggctcactgcaacctccgcctcacgggttccagcgattctcctgcctcagtctcctgagtagctgggactacagggcaacaggagtagttcactccgcgagaggccgtccacgagacccccgcgcgcagccatgagccccgccccccgctgttgcttggagaggggcgggacctggagagaggctgctccgtgaccccaccatgtcctctcctaccacgagttccctggatacccccctgcctggaaatggcccccctcagcctggcgccccttcttcttcacccactgtaaaggaggagggtccggagccgtggcccggggg

SEQ ID NO: 160845 - DNA, 1501 bp, Homo sapiens
  Payload ID: 11431
  Gene Symbol: NR1H3
  Gene Name: nuclear receptor subfamily 1, group H, member 3
  Uniprot ID: Q13133
  ENST ID: ENST00000395397
  CDS Start-End: 177-1385
ctggggtgcggggaaaaggcgcagtctcggtgggattgcgtgcaggagggtcgtggtctggctgtggcggaggagcataagaagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggaga

SEQ ID NO: 160846 - DNA, 1480 bp, Homo sapiens
  Payload ID: 11431
  Gene Symbol: NR1H3
  Gene Name: nuclear receptor subfamily 1, group H, member 3
  Uniprot ID: Q13133
  ENST ID: ENST00000405853
  CDS Start-End: 170-1333
cctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagg

SEQ ID NO: 160847 - DNA, 1352 bp, Homo sapiens
  Payload ID: 11431
  Gene Symbol: NR1H3
  Gene Name: nuclear receptor subfamily 1, group H, member 3
  ENST ID: ENST00000405576
  CDS Start-End: 177-1205
ctggggtgcggggaaaaggcgcagtctcggtgggattgcgtgcaggagggtcgtggtctggctgtggcggaggagcataagaagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagg

SEQ ID NO: 160848 - DNA, 1330 bp, Homo sapiens
  Payload ID: 11431
  Gene Symbol: NR1H3
  Gene Name: nuclear receptor subfamily 1, group H, member 3
  Uniprot ID: Q13133
  ENST ID: ENST00000407404
  CDS Start-End: 82-1245
tgcaggagggtcgtggtctggctgtggcggaggagcataagaaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaag

SEQ ID NO: 160849 - DNA, 1637 bp, Homo sapiens
  Payload ID: 11431
  Gene Symbol: NR1H3
  Gene Name: nuclear receptor subfamily 1, group H, member 3
  Uniprot ID: Q13133
  ENST ID: ENST00000441012
  CDS Start-End: 206-1549
ctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggc

SEQ ID NO: 160850 - DNA, 784 bp, Homo sapiens
  Payload ID: 11431
  Gene Symbol: NR1H3
  Gene Name: nuclear receptor subfamily 1, group H, member 3
  ENST ID: ENST00000444396
  CDS Start-End: 204-784
tccgggccgtgctgggacctttgctccacgaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccc

SEQ ID NO: 160851 - DNA, 440 bp, Homo sapiens
  Payload ID: 11431
  Gene Symbol: NR1H3
  Gene Name: nuclear receptor subfamily 1, group H, member 3
  ENST ID: ENST00000437276
  CDS Start-End: 236-440
tttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgttgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcacca

SEQ ID NO: 160852 - DNA, 911 bp, Homo sapiens
  Payload ID: 11431
  Gene Symbol: NR1H3
  Gene Name: nuclear receptor subfamily 1, group H, member 3
  ENST ID: ENST00000436029
  CDS Start-End: 276-911
aattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttgggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggc

SEQ ID NO: 160853 - DNA, 802 bp, Homo sapiens
  Payload ID: 11431
  Gene Symbol: NR1H3
  Gene Name: nuclear receptor subfamily 1, group H, member 3
  ENST ID: ENST00000436778
  CDS Start-End: 197-802
ggaaaaggcgcagtctcggtgggattgcgtgcaggagggtcgtggtctggctgtggcggaggagcataagaaggactccagattcaattatttatatatacttcaggatttaaactttgcttccagagttgtcatggaggaggccaagaagcaaatagagacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatc

SEQ ID NO: 160854 - DNA, 780 bp, Homo sapiens
  Payload ID: 11431
  Gene Symbol: NR1H3
  Gene Name: nuclear receptor subfamily 1, group H, member 3
  ENST ID: ENST00000420369
  CDS Start-End: 172-516
gtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgctcagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaa

SEQ ID NO: 160855 - DNA, 555 bp, Homo sapiens
  Payload ID: 11431
  Gene Symbol: NR1H3
  Gene Name: nuclear receptor subfamily 1, group H, member 3
  ENST ID: ENST00000419652
  CDS Start-End: 234-398
tttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgacagtgccttggtaatgaccagggctccaggaagagatgtccttgtggctgggggcccctgtgcctgacattcctcctgagagcagtccagagtcattcttagtcgtgcttgcctcccgcccagatcacctctcccctggttccagtgcctggcccttgcaggcacccgcccagtcctccccagtctggatttgctgctagagagttggccagctgagtgcttaccctgctctggctttgaagagttttatctgatctctgaaatgcatacactccagccccccaaagggacaaggattaacatcttcatttaaggtcctgagatactctgcggtggagctgtggaagccaggcgcac

SEQ ID NO: 160856 - DNA, 574 bp, Homo sapiens
  Payload ID: 11431
  Gene Symbol: NR1H3
  Gene Name: nuclear receptor subfamily 1, group H, member 3
  ENST ID: ENST00000412937
  CDS Start-End: 171-574
acgattctggaggctgctgggattggggtgggggttcctgggaggcagtccttttgcaagagctgctaagagcgctggactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaa

SEQ ID NO: 160857 - DNA, 552 bp, Homo sapiens
  Payload ID: 11431
  Gene Symbol: NR1H3
  Gene Name: nuclear receptor subfamily 1, group H, member 3
  ENST ID: ENST00000457932
  CDS Start-End: 321-552
tttgctccacgaggtgcctatggaggggagggaacacgattctggaggctgctgggattggggtgggggttcctgggaggcagtccttttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacag

SEQ ID NO: 160858 - DNA, 825 bp, Homo sapiens
  Payload ID: 11431
  Gene Symbol: NR1H3
  Gene Name: nuclear receptor subfamily 1, group H, member 3
  ENST ID: ENST00000449369
  CDS Start-End: 211-825
gggaggcagtccttttgcaagagctgctaagagcgctgggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccag

SEQ ID NO: 160859 - DNA, 2731 bp, Homo sapiens
  Payload ID: 11431
  Gene Symbol: NR1H3
  Gene Name: nuclear receptor subfamily 1, group H, member 3
  Uniprot ID: Q13133
  ENST ID: ENST00000467728
  CDS Start-End: 1239-2582
cttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgtgtgtatctggggtggggtcggggaatgtcctaaggatctgagaagggggtttctggggagaagtgaggggtgatggtgatggaagcttgggacaggagcaggactctgggtcccagaataactcatgaggggctcaggggaggaggtcctctatgtgaattggggagattcttggagacaggtttgtgctgggaccctggaaagtggcacgagcgaggttctctaataagcagcgtgtttcactgggtggagtgagctgtcctcagtgttggagtgagggggaaggggcccaagagaagcagggcagatgcacccaaacattccctgctggcctggaggggactttgggggagaaaagccggcacggtggctgggagcccagactttggagtcagaggagggttggagtcttgactctaccgccgcctaactgtgtgaccatagttacttaatctctttgaacctcagtttgcttatctgtaaaatgagtttaagaatagtcctgagccaggagcagtagcgtgcgcccataatctcagatactcaggaagctgaaacctgattgcttcagcccagtagtttgaggcgatagtgtcctattattgcacctgtgaatagcactgagttccagcctgggcaacatagagagaccccatctcaaaaaaaaaattaatagttttgacctcagagggatattatgaggaaagcacataaagccttataacaggctgggcgcagtggcttactccaataatccccacactttgggaggcccaggtgagaggatcacttgagcccaggaattcctagactagcctgggcaaaatagggagaacctgtctctaaaaaacataatagtaatataataaagccttagtacaggctaatatatggcaagtaaatgttagctgatattgttgatattgataaaagggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggt

SEQ ID NO: 160860 - DNA, 1065 bp, Homo sapiens
  Payload ID: 11431
  Gene Symbol: NR1H3
  Gene Name: nuclear receptor subfamily 1, group H, member 3
  ENST ID: ENST00000527949
  CDS Start-End: 54-944
tcctgtatccagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctc

SEQ ID NO: 160861 - DNA, 1704 bp, Homo sapiens
  Payload ID: 11431
  Gene Symbol: NR1H3
  Gene Name: nuclear receptor subfamily 1, group H, member 3
  ENST ID: ENST00000481889
  CDS Start-End: 169-1569
cggggaaaaggcgcagtctcggtgggattgcgtgcaggagggtcgtggtctggctgtggcggaggagcataagaagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtggctggagaagggcaagggatgaagggagaagcagagtgggattatctgtgggaggggcctccagacatcgagctgggagagccaaatctgctgggaagcagggatgaggagaatcggcctccctggaagaggccatgctccaagaccagccctcctagtccccgtttgaggtttgctgcttgtgtgcaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaa

SEQ ID NO: 160862 - DNA, 667 bp, Homo sapiens
  Payload ID: 11431
  Gene Symbol: NR1H3
  Gene Name: nuclear receptor subfamily 1, group H, member 3
  ENST ID: ENST00000531660
  CDS Start-End: 166-667
ggaaaaggcgcagtctcggtgggattgcgtgcaggagggtcgtggtctggctgtggcggaggagcataagaagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgcta

SEQ ID NO: 160863 - DNA, 1919 bp, Homo sapiens
  Payload ID: 11431
  Gene Symbol: NR1H3
  Gene Name: nuclear receptor subfamily 1, group H, member 3
  ENST ID: ENST00000616973
  CDS Start-End: 222-1583
gattctaacttagctaagcaatgctactggagaccataggcaaagccaaggtacagcttcagggaagtctttggtgagcccatctctcattaccaaggtaacgaagcgcagactccgggcccgggtgggcggcatcaccaccaggttcacgccgagaaggagctggaggagagccgcccggctccagccggaccgcttgcccgccatcaccgttgtaatctatgcagcaaacaagctggaacccgctgggtggcacctgcaagcagccgcccggacgcacccactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggttgcgagttttgtggctactgagcagtggagccctcgctaacactgtgctgtgtctgaagatcatgctgaccccacaaacggatgggcctgggggccactttgcacagggttctccagagccctgcccatcctgcctccaccacttcctgtttttcccacagggccccaagaaaaattctccactgtc

SEQ ID NO: 160864 - DNA, 1630 bp, Homo sapiens
  Payload ID: 11432
  Gene Symbol: NR1H4
  Gene Name: nuclear receptor subfamily 1, group H, member 4
  Uniprot ID: Q96RI1
  ENST ID: ENST00000188403
  CDS Start-End: 29-1477
attttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaat

SEQ ID NO: 160865 - DNA, 1779 bp, Homo sapiens
  Payload ID: 11432
  Gene Symbol: NR1H4
  Gene Name: nuclear receptor subfamily 1, group H, member 4
  ENST ID: ENST00000321046
  CDS Start-End: 334-1146
tcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcaggtgtaggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtc

SEQ ID NO: 160866 - DNA, 1778 bp, Homo sapiens
  Payload ID: 11432
  Gene Symbol: NR1H4
  Gene Name: nuclear receptor subfamily 1, group H, member 4
  Uniprot ID: Q96RI1
  ENST ID: ENST00000392986
  CDS Start-End: 334-1764
tcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgtatacaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggg

SEQ ID NO: 160867 - DNA, 496 bp, Homo sapiens
  Payload ID: 11432
  Gene Symbol: NR1H4
  Gene Name: nuclear receptor subfamily 1, group H, member 4
  ENST ID: ENST00000548621
  CDS Start-End: 24-197
tgcatttcaattgaaaaatttggatgggatcaaaaatgaatctcattgaacattcccatttacctaccacagatgaattttctttttctgaaaatttatttgatttcctgggttggttccaatctctgccatctactaccctgtggtcttggacaaattccttaactttgcacaagttacttgccttatttaaataaggtgataagaagaatgcctggcacatcacaagtactctatttgccactaaaattcactctcacaacacacctataagggcttctcagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaatttaccttttcagaaagcatactctaaatt

SEQ ID NO: 160868 - DNA, 565 bp, Homo sapiens
  Payload ID: 11432
  Gene Symbol: NR1H4
  Gene Name: nuclear receptor subfamily 1, group H, member 4
  ENST ID: ENST00000546380
  CDS Start-End: 295-432
ggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttgggcttctcagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaa

SEQ ID NO: 160869 - DNA, 294 bp, Homo sapiens
  Payload ID: 11432
  Gene Symbol: NR1H4
  Gene Name: nuclear receptor subfamily 1, group H, member 4
  ENST ID: ENST00000551184
  CDS Start-End: 1-103
gtcaggatttttcatggaaatgatgagtatgaagcccgcgaaagggcttctcagactcccctggagtccatccatgtgttctcatttaagaactcgtccctaaacttccatggagaaccgtcacaaaggaatcctaattctcatactctttgataggctaattccaaaataaagattcctaaatctaaattttaatatgtattttcccttttaaattgtatcaaaatagaaataaatttaccttttcagaaagcatactctaaattaaagtcgaactacctctactccctccac

SEQ ID NO: 160870 - DNA, 1489 bp, Homo sapiens
  Payload ID: 11432
  Gene Symbol: NR1H4
  Gene Name: nuclear receptor subfamily 1, group H, member 4
  Uniprot ID: Q96RI1
  ENST ID: ENST00000551379
  CDS Start-End: 29-1489
attttcagtggctgtgaataagctaagaatggtaatgcagtttcaggggttagaaaatccaattcaaattagtcctcactgcagctgtacgccgtcaggatttttcatggaaatgatgagtatgaagcccgcgaaaggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgtatgtatacaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtga

SEQ ID NO: 160871 - DNA, 2884 bp, Homo sapiens
  Payload ID: 11432
  Gene Symbol: NR1H4
  Gene Name: nuclear receptor subfamily 1, group H, member 4
  Uniprot ID: Q96RI1
  ENST ID: ENST00000548884
  CDS Start-End: 542-1960
acattcctcattctggggctttgcggttttgtcttgggaatctcgaggctctcccaaggttcctttctatgtttatatcatttagcagggaaggattgttaatgactaatctgtgtccatgaggcacagagccaaggaagagatgctgctgctagcccagaaggccgcctgtgatcatgcacagtacactggaactctctcctcctcctcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggtttcttcaggagaagcattaccaaaaacgctgtgtacaagtgtaaaaacgggggcaactgtgtgatggatatgtacatgcgaagaaagtgtcaagagtgtcgactaaggaaatgcaaagagatgggaatgttggctgaatgcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtctagctcctttttctctctcatattaatctgatgtataactttcctttatttcacttgtacccagtttcactcaagaaatcttgatgaatatttatgttgtaattacatgtgtaacttccacaactgtaaatattgggctagatagaacaactttctctacattgtgttttaaaaggctccagggaatcctgcattctaattggcaagccctgtttgcctaattaaattgattgttacttcaattctatctgttgaactagggaaaatctcattttgctcatcttaccatattgcatatattttattaaagagttgtattcaatcttggcaataaagcaaacataatggcaacaggattttctttgggaacaaaatttgataaatatacaaactcatttctttaaatgttgaaagacatcctattgaatctgagggggtaatttacagaaagatactgtctctcgcacttttgtcatctctggaaaagtcctggtgaatagtcattcatttgtaatagccctctgatcatttccttttctttgaagttcaaagagaatagcaaacagaaaagttaacaattttcacataaaatattccctcaagcaatcctttcccccatagttagtcttgaggcaggattcacaaattcagagtatgcagctaactgcagtgatgggaccttcgctttcctctcttaaaagtgaggaaatgattggcttcattgtatccaatcatctttctgttttgttttgcttttgaaaacattcctacagctgggagcacagctgctgtatacttcccccaaagcaggaattagttcatttccttccttcattgttacactgttgcattcttctccctattatcctttggtgaatacaataaaacaccttctataagta

SEQ ID NO: 160872 - DNA, 1633 bp, Homo sapiens
  Payload ID: 11432
  Gene Symbol: NR1H4
  Gene Name: nuclear receptor subfamily 1, group H, member 4
  Uniprot ID: Q96RI1
  ENST ID: ENST00000549996
  CDS Start-End: 334-1611
tcacctcattgtctccccgacttatcctaatgcgaaattggattctgagcatttgtagcaaaatcgctgggatctggagaggaagactcagtccagaatcctcccagggccttgaaagtccatctctgacccaaaacaatccaaggaggtagaagacatcgtagaaggagtgaaagaagaaaagaagacttagaaacatagctcaaagtgaacactgcttctcttagtttcctggatttcttctggacatttcctcaagatgaaacttcagacactttggagttttttttgaagaccaccataaagaaagtgcatttcaattgaaaaatttggatgggatcaaaaatgaatctcattgaacattcccatttacctaccacagatgaattttctttttctgaaaatttatttggtgttttaacagaacaagtggcaggtcctctgggacagaacctggaagtggaaccatactcgcaatacagcaatgttcagtttccccaagttcaaccacagatttcctcgtcatcctattattccaacctgggtttctacccccagcagcctgaagagtggtactctcctggaatatatgaactcaggcgtatgccagctgagactctctaccagggagaaactgaggtagcagagatgcctgtaacaaagaagccccgcatgggcgcgtcagcagggaggatcaaaggggatgagctgtgtgttgtttgtggagacagagcctctggataccactataatgcactgacctgtgaggggtgtaaaggcttgttaactgaaattcagtgtaaatctaagcgactgagaaaaaatgtgaagcagcatgcagatcagaccgtgaatgaagacagtgaaggtcgtgacttgcgacaagtgacctcgacaacaaagtcatgcagggagaaaactgaactcaccccagatcaacagactcttctacattttattatggattcatataacaaacagaggatgcctcaggaaataacaaataaaattttaaaagaagaattcagtgcagaagaaaattttctcattttgacggaaatggcaaccaatcatgtacaggttcttgtagaattcacaaaaaagctaccaggatttcagactttggaccatgaagaccagattgctttgctgaaagggtctgcggttgaagctatgttccttcgttcagctgagattttcaataagaaacttccgtctgggcattctgacctattggaagaaagaattcgaaatagtggtatctctgatgaatatataacacctatgtttagtttttataaaagtattggggaactgaaaatgactcaagaggagtatgctctgcttacagcaattgttatcctgtctccagatagacaatacataaaggatagagaggcagtagagaagcttcaggagccacttcttgatgtgctacaaaagttgtgtaagattcaccagcctgaaaatcctcaacactttgcctgtctcctgggtcgcctgactgaattacggacattcaatcatcaccacgctgagatgctgatgtcatggagagtaaacgaccacaagtttaccccacttctctgtgaaatctgggacgtgcagtgatggggattacaggggaggggtc

SEQ ID NO: 160873 - DNA, 2743 bp, Homo sapiens
  Payload ID: 11433
  Gene Symbol: NR1I2
  Gene Name: nuclear receptor subfamily 1, group I, member 2
  Uniprot ID: O75469
  ENST ID: ENST00000337940
  CDS Start-End: 49-1470
ggcctgctgggttagtgctggcagccccctgaggccaaggacagcagcatgacagtcaccaggactcaccacttcaaggaggggtccctcagagcacctgccatacccctgcacagtgctgcggctgagttggcttcaaaccatccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacgatttggatcaaaaggagaaatgataagtgacaaaagcagcacaaggaatttccctgtgtggatgctgagctgtgatggcgggcactgggtacccaagtgaaggttcccaaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggcta

SEQ ID NO: 160874 - DNA, 4417 bp, Homo sapiens
  Payload ID: 11433
  Gene Symbol: NR1I2
  Gene Name: nuclear receptor subfamily 1, group I, member 2
  ENST ID: ENST00000393716
  CDS Start-End: 1840-3144
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactctttttctttccaatatcctcatgacattcaatatttcacttactctaggtcctccctgcctaaggcccaagtcaactttctgtccagtgggatttgtaatccaatacctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacgatttggatcaaaaggagaaatgataagtgacaaaagcagcacaaggaatttccctgtgtggatgctgagctgtgatggcgggcactgggtacccaagtgaaggttcccaaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggcta

SEQ ID NO: 160875 - DNA, 4306 bp, Homo sapiens
  Payload ID: 11433
  Gene Symbol: NR1I2
  Gene Name: nuclear receptor subfamily 1, group I, member 2
  ENST ID: ENST00000466380
  CDS Start-End: 1840-3033
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactctttttctttccaatatcctcatgacattcaatatttcacttactctaggtcctccctgcctaaggcccaagtcaactttctgtccagtgggatttgtaatccaatacctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccgggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacgatttggatcaaaaggagaaatgataagtgacaaaagcagcacaaggaatttccctgtgtggatgctgagctgtgatggcgggcactgggtacccaagtgaaggttcccaaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggcta

SEQ ID NO: 160876 - DNA, 1074 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000367979
  CDS Start-End: 1-1074
atggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctga

SEQ ID NO: 160877 - DNA, 1403 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000367980
  CDS Start-End: 204-1277
ataaaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagc

SEQ ID NO: 160878 - DNA, 1076 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000367981
  CDS Start-End: 42-1016
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 160879 - DNA, 1322 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000367982
  CDS Start-End: 157-1215
taactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggt

SEQ ID NO: 160880 - DNA, 1473 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000367983
  CDS Start-End: 296-1342
gtcatgctgggaaaacctcccacccaggcctttgccctgagtccagggtctgtgccctaaccccacagtcactgagagcaactggaggccacataaaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaataa

SEQ ID NO: 160881 - DNA, 1059 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000367984
  CDS Start-End: 105-1034
gggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagc

SEQ ID NO: 160882 - DNA, 1074 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000367985
  CDS Start-End: 105-1049
gggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagc

SEQ ID NO: 160883 - DNA, 989 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000412844
  CDS Start-End: 42-989
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 160884 - DNA, 1114 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000442691
  CDS Start-End: 95-1114
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 160885 - DNA, 973 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000437437
  CDS Start-End: 42-962
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatgaaagactaaagc

SEQ ID NO: 160886 - DNA, 1117 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000428574
  CDS Start-End: 95-1117
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 160887 - DNA, 774 bp, Homo sapiens
  Payload ID: 11434
  Gene Symbol: NR1I3
  Gene Name: nuclear receptor subfamily 1, group I, member 3
  ENST ID: ENST00000502985
  CDS Start-End: 95-538
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacattccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 160888 - DNA, 1130 bp, Homo sapiens
  Payload ID: 11434
  Gene Symbol: NR1I3
  Gene Name: nuclear receptor subfamily 1, group I, member 3
  ENST ID: ENST00000515621
  CDS Start-End: 249-1070
ggagaggcattccataccagattctgtggcctgcaggtgacatgctgcctaagagaagcaggagtctgtgacagccaccccaacacgtgacgtcatggccagtagggaagatgagctgaggaactgtgtggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 160889 - DNA, 634 bp, Homo sapiens
  Payload ID: 11434
  Gene Symbol: NR1I3
  Gene Name: nuclear receptor subfamily 1, group I, member 3
  ENST ID: ENST00000508387
  CDS Start-End: 42-398
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacattccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 160890 - DNA, 891 bp, Homo sapiens
  Payload ID: 11434
  Gene Symbol: NR1I3
  Gene Name: nuclear receptor subfamily 1, group I, member 3
  ENST ID: ENST00000512340
  CDS Start-End: 42-314
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacacctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 160891 - DNA, 1441 bp, Homo sapiens
  Payload ID: 11434
  Gene Symbol: NR1I3
  Gene Name: nuclear receptor subfamily 1, group I, member 3
  ENST ID: ENST00000506209
  CDS Start-End: 144-1037
agacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtacggtgggacactgagggcttggaggccacaccagggcaggaaggggttggtgaaacattgagcttgggaggaatgtttttttactgtcctttccttagggaattcaggtatcgtggggtctagtccttccccctggccatccctgtctcacatcgtttcagcatccaaattgctgtatttggatactgctgtttcatctcactttttccagattttttttttattcagtacagatgcaaagtagtagctcagaggctctgggtaatagcattcctgagattgatgacatccattacctcactagtccaacttctccagactaacgcagacttttctcttcccttggcctttcctctcctcgccattgggccaattccttcgatttctcatttcccttgaagttagggccattcacagtttcatggtcaaagccagttccaggttcaatagtctgtgatttatcca

SEQ ID NO: 160892 - DNA, 977 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000508740
  CDS Start-End: 42-977
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgctccctatcttacagaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 160893 - DNA, 944 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000504010
  CDS Start-End: 42-884
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 160894 - DNA, 1380 bp, Homo sapiens
  Payload ID: 11434
  Gene Symbol: NR1I3
  Gene Name: nuclear receptor subfamily 1, group I, member 3
  ENST ID: ENST00000506018
  CDS Start-End: 104-928
taactccaatcactggcaactcctgagatcagaggaaaaccagcaacagcgtgggagtttggggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtatctcccacagtggggttccaggtagagtttttggagttgctctttcacttccatggaacactacgaaaactgcagctccaagagcctgagtatgtgctcttggctgccatggccctcttctctcctggtgagcacctcccaaagcccagagccttttgctgcaccacctctgcccaaatactcagctccttgagtccatccacccaggccttctagcctagctatcaaacctgcagactaggtctatcccagcctcagtccccggggcaccacgcaggcccacccctgccacccaacttgtccttcccagctccctatcttacagaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggt

SEQ ID NO: 160895 - DNA, 985 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000505005
  CDS Start-End: 95-985
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatga

SEQ ID NO: 160896 - DNA, 861 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000512372
  CDS Start-End: 42-845
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaaaatgctgggaccaaagattgggccgggttcaaagggagcccagtggttgcaatgaaagactaaagcaataa

SEQ ID NO: 160897 - DNA, 774 bp, Homo sapiens
  Payload ID: 11434
  Gene Symbol: NR1I3
  Gene Name: nuclear receptor subfamily 1, group I, member 3
  ENST ID: ENST00000510951
  CDS Start-End: 42-314
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacacctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 160898 - DNA, 620 bp, Homo sapiens
  Payload ID: 11434
  Gene Symbol: NR1I3
  Gene Name: nuclear receptor subfamily 1, group I, member 3
  ENST ID: ENST00000507215
  CDS Start-End: 42-314
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacacctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaa

SEQ ID NO: 160899 - DNA, 914 bp, Homo sapiens
  Payload ID: 11434
  Gene Symbol: NR1I3
  Gene Name: nuclear receptor subfamily 1, group I, member 3
  ENST ID: ENST00000502848
  CDS Start-End: 95-454
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacacctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 160900 - DNA, 620 bp, Homo sapiens
  Payload ID: 11434
  Gene Symbol: NR1I3
  Gene Name: nuclear receptor subfamily 1, group I, member 3
  ENST ID: ENST00000511944
  CDS Start-End: 95-538
ggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacattccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaa

SEQ ID NO: 160901 - DNA, 1093 bp, Homo sapiens
  Payload ID: 11434
  Gene Symbol: NR1I3
  Gene Name: nuclear receptor subfamily 1, group I, member 3
  ENST ID: ENST00000515452
  CDS Start-End: 238-954
aaccccacagtcactgagagcaactggaggccacataaaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtggtgagatggtgctagagcaatagggggcatgtgtcctcatggtacaggatgtggtcaggtgacctagaggctcctaatcctagtatctcccacagtggggttccaggtagagtttttggagttgctctttcacttccatggaacactacgaaaactgcagct

SEQ ID NO: 160902 - DNA, 1061 bp, Homo sapiens
  Payload ID: 11434
  Gene Symbol: NR1I3
  Gene Name: nuclear receptor subfamily 1, group I, member 3
  Uniprot ID: Q14994
  ENST ID: ENST00000511676
  CDS Start-End: 42-1001
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaa

SEQ ID NO: 160903 - DNA, 480 bp, Homo sapiens
  Payload ID: 11434
  Gene Symbol: NR1I3
  Gene Name: nuclear receptor subfamily 1, group I, member 3
  ENST ID: ENST00000511748
  CDS Start-End: 42-398
ggagaggcattccataccagattctgtggcctgcaggtgacatgctgcctaagagaagcaggagaacagtcagcaaaagcattggtcccacctgcccctttgctggaagctgtgaagtcagcaagactcagaggcgccactgcccagcctgcaggttgcagaagtgcttagatgctggcatgaggaaagacattccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgaccgacctggagttacccagagagatgagattgatcagctgcaagaggagatggcactgactctgcaaagctacatcaagggccagcagcgaaggccccgggatcgctcacctggaacaccctggatacactggagtgggaa

SEQ ID NO: 160904 - DNA, 1201 bp, Homo sapiens
  Payload ID: 11434
  Gene Symbol: NR1I3
  Gene Name: nuclear receptor subfamily 1, group I, member 3
  ENST ID: ENST00000628566
  CDS Start-End: 204-563
ataaaacagacatctcttgttttccagatactacgggtcataatccctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacacctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagact

SEQ ID NO: 160905 - DNA, 2014 bp, Homo sapiens
  Payload ID: 11435
  Gene Symbol: NR2C1
  Gene Name: nuclear receptor subfamily 2, group C, member 1
  Uniprot ID: P13056
  ENST ID: ENST00000330677
  CDS Start-End: 166-1617
ccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagatgccaaggtaattgcagccctcattcatttcacaagacgagcaatcactgatttataaatgcttaactatagaatggcttatgactacccaaaacagtgccccatcaacaaatggggaaaattgccttttgagctcaggaataatttataaattggggactaccttttagttctttagcatattctatttcttattgttttatataatttttaaatcatttgcttcctccttatgtttaacagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattgt

SEQ ID NO: 160906 - DNA, 4143 bp, Homo sapiens
  Payload ID: 11435
  Gene Symbol: NR2C1
  Gene Name: nuclear receptor subfamily 2, group C, member 1
  Uniprot ID: P13056
  ENST ID: ENST00000333003
  CDS Start-End: 332-2143
gtggactcacagagccgctgctcggccctccgatccctccaccccaccctgggaacgtcacgacctcctctcgccgcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagataaaatgtcaacagaaagaagaaaattattgatggagcacatcttcaaactacaggagttttgtaacagcatggttaaactctgcattgatggatacgaatatgcctacctgaaggcaatagtactcttcagtccagatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaattgtgttctagtcatatttaacttcattatgaactagtaaaaatacttaatggtcagaaatccctaaggagttagttccttgcattttactctgccataataatttttgtttaattaccatatcaaaataagattattttatgcttactggtataatgacagtattagaactataggaaataattgaatacatattttttgtcttctctaaatatcatggtgtcccttagcatatactactctcattgctggcagtgagacaggccattcatgatcttaagagttgccatttttaatgtatattattagttacaagcactttatatagcagaaaattgtttttgagaataagctagtgttgatattttaatatttttagcttactgctcgtgtttttgtttttgttttcgtttatagaggtgggtttcactgttgcccaggctggtctcaaactcctgggctcaagtgatcctgcctcagcctcccaaagtactgggattacaggcgcgtgccaccgtgcctggcctactgctgtctttgaaaataatagagactagccaggtgtagtggctcatgcctataatcccagcactttgggaggctgaggcaggcagattgcttgagctcaggagttcgagaccagcctgggcaatatagcaagacctcgtctctgtaaaaagaaagaaagtaataaagactaattgagcccaaaatgtttcactatttcaaaaaagatatttaaattgttgctctttcattccataaaaaggatctgatctctctcccacttttctgacctgagttagagcttcccaaacctgtcatgtatgggttttagccaatttcttttagatcactaaaaaaactcacccaatatgtcaaataatggatttatcatagccagtacatgttctcaaggcaagtttaaacattattttgaagctattgataattttttaaaataaagaaatattcactgatttttttcactgtaaagcacgggagggctgctttaacaacagtataagaatcagcctgaagccttgttactgctacaacaaattcattttagactcctcggatgtcttccacagtaatttattcttttagcaaacctgatactgataactgtttctttgctttgatttcttgatgaattattttggtatgtttgttgatttttaaagcaaacacggataatgcactcagagtacattttttgtaaagatttttgcaatagaagaaaagtgaagtttttgtggggatgtggattttattgcttactactttatagtaatcaaaagtttgaaaatatcaacttacagtctttaccagtttactaagggaaacttttttccctatttaaaacatgatcttagtcaacaattttatttataattatcagctaaattacatttagtataatactcaaatggaaaaatcagtagtttatacctttataaatacagtttagtaagccaaggaatcagggaaataatcctttaaaataatgtactaatagttaagatgtttcaggtgttttttctgattaaatttgctactatatttggaagactttaaaactatattaaaatgtgacttgcattacaaatttctgtgtcttaccagtatatttgtaaatatattattcattttccttttca

SEQ ID NO: 160907 - DNA, 1822 bp, Homo sapiens
  Payload ID: 11435
  Gene Symbol: NR2C1
  Gene Name: nuclear receptor subfamily 2, group C, member 1
  Uniprot ID: P13056
  ENST ID: ENST00000393101
  CDS Start-End: 209-1612
cgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattgtaaaacttta

SEQ ID NO: 160908 - DNA, 591 bp, Homo sapiens
  Payload ID: 11435
  Gene Symbol: NR2C1
  Gene Name: nuclear receptor subfamily 2, group C, member 1
  ENST ID: ENST00000552791
  CDS Start-End: 1-142
agatctttctcaaaatagtaatgaaatgtctatgattgaaagcttaagcaatgatgatacctctttgtgtgaatttcaagaaatgcagaccaacggtgatgtttcaagctcaccatgccttctcctatgcctgagtacctgaatgtgcactacattggggagtctgcctccagactgctgttcttatcaatgcactgggcactttcgattccttctttccaggctctagggcaagaaaacagcatatcactggtgaaagcttactggaatgaactttttactcttggtcttgcccagtgctggcaagtgatgaatgtagcaactatattagcaacatttgtcaattgtcttcacaatagtcttcaacaagcagaggggtaatcaccttaaaatgtcatcaaaaatagatctactagaaggcagcatcacattcccatcttacttatggactcctacccctggttcatgtcttatatgcctgtaatggttataaagcctaccttcaggaaagctatggttgactaattactaatggatgggttttaaacatgtccctctacaataaattaaaatctttattgtaaaacttta

SEQ ID NO: 160909 - DNA, 433 bp, Homo sapiens
  Payload ID: 11435
  Gene Symbol: NR2C1
  Gene Name: nuclear receptor subfamily 2, group C, member 1
  ENST ID: ENST00000547469
  CDS Start-End: 386-433
gggagagccgcgcgcagcgccggggcttccagggcgcacggctaacgccggcacgagtgagacgtgggagaggccgaccctcggctagtggccgcaagtcccggcctgcatcccgtcactaactcccgtgctttcacgggacggacagaatgactccccccactttcacttttctctcacggcaaatctggccagggtcgtcgctgcctgtgggcctggatcttttcagaagaaatggaacggccccagggttctcactgcagggggcatgtccaagcttccgatagatagctcttttgttaagaaataattcttccaactcgggcagataccatttttgtgcagtacgaatgttgccaggttgtcccataatcttcagtagatcatggcaaccatagaagaaattgcacatcaaattattgaacaacagatg

SEQ ID NO: 160910 - DNA, 740 bp, Homo sapiens
  Payload ID: 11435
  Gene Symbol: NR2C1
  Gene Name: nuclear receptor subfamily 2, group C, member 1
  ENST ID: ENST00000551647
  CDS Start-End: 1-220
gctcaccatgccttctcctatgcctgagtacctgaatgtgcactacattggggagtctgcctccagactgctgttcttatcaatgcactgggcactttcgattccttctttccaggctctaggatcatccaagcctagaaaacatggaacagatagagaaatttcaggaaaaggcttatgtggaattccaagattatataaccaaaacatatccagatgacacctacaggttatccagactactactcagattgccagctttaagactgatgaatgctaccatcactgaagaattgtttttcaaaggtctcattggcaatatacgaattgacagtgttatcccacatattttgaaaatggagcctgcagattataactctcaaataattggtcacagcatttgaaaactgtgactgcagtgctgtaaacttaactgttctttgccagaacacaagacaccaaattgaactcactgcttttgaggcatctggaaatttttactttaaaaagtaaccagaatccaaggtatttttattttagcttcccttaagaatttttgaagtgactgggcaggcagcagaaattaaatgaatttttcttcctgattcctttaaatgaatatgaaacactacaaatttattcttggtgaagatgatacctgaagctgtcacctcttgattatctaaactaagcgctcattctattttataaaacaaataaattagtctcttttttctgaa

SEQ ID NO: 160911 - DNA, 1561 bp, Homo sapiens
  Payload ID: 11435
  Gene Symbol: NR2C1
  Gene Name: nuclear receptor subfamily 2, group C, member 1
  ENST ID: ENST00000622476
  CDS Start-End: 257-1561
gcttctccccgttgctaatgcgcaggcgctggcgggatagcgcgccgccgagccgagaaagaggtcacgaactctgaccccccagaaatacccaaacacagaaagctctctccgccgtgaatctcgatcccacatcccgtcggctttcttcaacctctcttcccggagcgccccccaatccacgagtggcagccgcgggactgtcgcgtcggcgcccgacgccggagtcagcagggcgcaaaagcgccggtagatcatggcaaccatagaagaaattgcacatcaaattattgaacaacagatgggagagattgttacagagcagcaaactgggcagaaaatccagattgtgacagcacttgatcataatacccaaggcaagcagttcattctgacaaatcacgacggctctactccaagcaaagtcattctggccaggcaagattccactccgggaaaagttttccttacaactccagatgcagcaggtgtcaaccagttattttttaccactcctgatctgtctgcacaacacctgcagctcctaacagataattctccagaccaaggaccaaataaggtttttgatctttgcgtagtatgtggagacaaagcatcaggacgtcattatggagcagtaacttgtgaaggctgcaaaggattttttaaaagaagcatccgaaaaaatttagtatattcatgtcgaggatcaaaggattgtattattaataagcaccaccgaaaccgctgtcaatactgcaggttacagagatgtattgcgtttggaatgaagcaagactctgtccaatgtgaaagaaaacccattgaagtatcacgagaaaaatcttccaactgtgccgcttcaacagaaaaaatctatatccgaaaggaccttcgtagcccattaactgcaactccaacttttgtaacagatagtgaaagtacaaggtcaacaggactgttagattcaggaatgttcatgaatattcatccatctggagtaaaaactgagtcagctgtgctgatgacatcagataaggctgaatcatgtcagggagatttaagtacattggccaatgtggttacatcattagcgaatcttggaaaaactaaagatctttctcaaaatagtaatgaaatgtctatgattgaaagcttaagcaatgatgatacctctttgtgtgaatttcaagaaatgcagaccaacggtgatgtttcaagggcatttgacactcttgcaaaagcattgaatcctggagagagcacagcctgccagagctcagtagcgggcatggaaggaagtgtacacctaatcactggagattcaagcataaattacaccgaaaaagaggggccacttctcagcgattcacatgtagctttcaggctcaccatgccttctcctatgcctgagtacctgaatgtgcactacattggggagtctgcctccagactgctgttcttatcaatgcactgggcactttcgattccttctttccaggctctaggaaagaagaaaattattgatggagcacatcttcaaactacaggagttttgtaa

SEQ ID NO: 160912 - DNA, 2406 bp, Homo sapiens
  Payload ID: 11436
  Gene Symbol: NR2C2
  Gene Name: nuclear receptor subfamily 2, group C, member 2
  Uniprot ID: P49116
  ENST ID: ENST00000323373
  CDS Start-End: 218-2065
ccgctcccacctcggcgtctcgtctctcgcccgctgccccgcgagcccgcggcccccgggctcccgccatccgccgacaccgggagcccgggctccccgcgccctgccctccgcgccgggggccgcccgccgcagacacgggacccgcttcgaggccgctttggcgccaaatcctgaggtaacacgtacacagacctctcggccggaatctccagggatgaccagcccctccccacgcatccagataatctccaccgactctgctgtagcctcacctcagcgcattcagggctctgaacctgcctctggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaa

SEQ ID NO: 160913 - DNA, 1937 bp, Homo sapiens
  Payload ID: 11436
  Gene Symbol: NR2C2
  Gene Name: nuclear receptor subfamily 2, group C, member 2
  Uniprot ID: P49116
  ENST ID: ENST00000393102
  CDS Start-End: 126-1916
aggttctctaatgatcttggttcaccatggctacaaatatggaggggctggttcagcacagagtggggacccagcaggtggctgaggtaacacgtacacagacctctcggccggaatctccagggatgaccagcccctccccacgcatccagataatctccaccgactctgctgtagcctcacctcagcgcattcagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaa

SEQ ID NO: 160914 - DNA, 1791 bp, Homo sapiens
  Payload ID: 11436
  Gene Symbol: NR2C2
  Gene Name: nuclear receptor subfamily 2, group C, member 2
  Uniprot ID: P49116
  ENST ID: ENST00000406272
  CDS Start-End: 1-1791
atgaccagcccctccccacgcatccagataatctccaccgactctgctgtagcctcacctcagcgcattcagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatag

SEQ ID NO: 160915 - DNA, 2494 bp, Homo sapiens
  Payload ID: 11436
  Gene Symbol: NR2C2
  Gene Name: nuclear receptor subfamily 2, group C, member 2
  Uniprot ID: P49116
  ENST ID: ENST00000425241
  CDS Start-End: 363-2153
aacattcgccctcctcctaccagcgcgcgggcggcggcggcggcggcaccggggtcacgaactctgacctttcactgacaaaaacaataacaaacccccccttctccgcgaccccggcggcgcccccgggcccgtccccgccaccccgctcccacctcggcgtctcgtctctcgcccgctgccccgcgagcccgcggcccccgggctcccgccatccgccgacaccgggagcccgggctccccgcgccctgccctccgcgccgggggccgcccgccgcagacacgggacccgcttcgaggccgctttggcgccaaatcctgaggtaacacgtacacagacctctcggccggaatctccagggatgaccagcccctccccacgcatccagataatctccaccgactctgctgtagcctcacctcagcgcattcagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaa

SEQ ID NO: 160916 - DNA, 495 bp, Homo sapiens
  Payload ID: 11436
  Gene Symbol: NR2C2
  Gene Name: nuclear receptor subfamily 2, group C, member 2
  ENST ID: ENST00000435454
  CDS Start-End: 388-495
gcccccgggcccgtccccgccaccccgctcccacctcggcgtctcgtctctcgcccgctgccccgcgagcccgcggcccccgggctcccgccatccgccgacaccgggagcccgggctccccgcgccctgccctccgcgccgggggccgcccgccgcagacacgggacccgcttcgaggccgctttggcgccaaatcctgaggaccgcctatggctgcggtagcagtgagagaagctctcagaaggtgcacattcctccttgttcatttttaagcagcttccaaagctgctgttgatgatgcctgatgctgctttgaaggcagaaaaccaacagtgagatcaagaattgtaacacgtacacagacctctcggccggaatctccagggatgaccagcccctccccacgcatccagataatctccaccgactctgctgtagcctcacctcagcgcattcagggctctgaacctgcctctggcccattgagtgttttc

SEQ ID NO: 160917 - DNA, 739 bp, Homo sapiens
  Payload ID: 11436
  Gene Symbol: NR2C2
  Gene Name: nuclear receptor subfamily 2, group C, member 2
  ENST ID: ENST00000437120
  CDS Start-End: 124-739
gttctctaatgatcttggttcaccatggctacaaatatggaggggctggttcagcacagagtggggacccagcaggtggctgaggtaacacgtacacagacctctcggccggaatctccagggatgaccagcccctccccacgcatccagataatctccaccgactctgctgtagcctcacctcagcgcattcagggctctgaacctgcctctggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatgtg

SEQ ID NO: 160918 - DNA, 564 bp, Homo sapiens
  Payload ID: 11436
  Gene Symbol: NR2C2
  Gene Name: nuclear receptor subfamily 2, group C, member 2
  ENST ID: ENST00000413118
  CDS Start-End: 363-564
aacattcgccctcctcctaccagcgcgcgggcggcggcggcggcggcaccggggtcacgaactctgacctttcactgacaaaaacaataacaaacccccccttctccgcgaccccggcggcgcccccgggcccgtccccgccaccccgctcccacctcggcgtctcgtctctcgcccgctgccccgcgagcccgcggcccccgggctcccgccatccgccgacaccgggagcccgggctccccgcgccctgccctccgcgccgggggccgcccgccgcagacacgggacccgcttcgaggccgctttggcgccaaatcctgaggtaacacgtacacagacctctcggccggaatctccagggatgaccagcccctccccacgcatccagataatctccaccgactctgctgtagcctcacctcagcgcattcagattgtcacagaccagcagacaggacagaaaatccagatagtcaccgcagtggacgcctccggatcccccaaacagcagttcatcctgaccagcccagatggagctggaactgggaaggtgatcctggctt

SEQ ID NO: 160919 - DNA, 698 bp, Homo sapiens
  Payload ID: 11436
  Gene Symbol: NR2C2
  Gene Name: nuclear receptor subfamily 2, group C, member 2
  ENST ID: ENST00000439011
  CDS Start-End: 1-669
tgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccggtcaaaccaaacaactcactcattcttccccaagatttttctgatgtgctccatgatctccttattgctcttggtctccacatccaccaggacctgctccccagaatctggaaacggaaagcacggggcagaagagaaacagaactcacagcgcactcagcctcaaaaagttgtaatttgggacttgcttttagtggcagaaacattttaataataaaatagatatacttgtttacataa

SEQ ID NO: 160920 - DNA, 551 bp, Homo sapiens
  Payload ID: 11436
  Gene Symbol: NR2C2
  Gene Name: nuclear receptor subfamily 2, group C, member 2
  ENST ID: ENST00000413194
  CDS Start-End: 1-522
cctttctatattcctaggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccggacctgctccccagaatctggaaacggaaagcacggggcagaagagaaacagaactcacagcgcactcagcctcaaaaagttgtaatttgggacttgcttttagtggcagaaacattttaataataaaatagatatacttgtttacataa

SEQ ID NO: 160921 - DNA, 8113 bp, Homo sapiens
  Payload ID: 11436
  Gene Symbol: NR2C2
  Gene Name: nuclear receptor subfamily 2, group C, member 2
  Uniprot ID: P49116
  ENST ID: ENST00000617312
  CDS Start-End: 1-1848
atgaccagcccctccccacgcatccagataatctccaccgactctgctgtagcctcacctcagcgcattcagggctctgaacctgcctctggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctccatcataactgtgaggctggattggggctgggcaggagcctgctgccgcctggcgagagtggttagggcctggtaaagctggatggaaggtttcaggacaatttcttcctgttgaccttaaataccagagattttaaaaatgtgtatagactcagcatctctgttggcaagtctgttaatgttaccagcacactgtgcactttggttcccccaggtgtgtgccagccgaccaccccggagcattttaaatgcaggctgcttgctccttaaaaacaaccctcaatttccagggtgatagtctttctcctcataaattgtagcaaccagagtttacagcaagaacagtatgcgcttaaaaggaagttatgtctaacttcaaacacccgtaaattcccacggatgtgaatatatagcaagcttttcctgtttgagaacagtggcatgtggaagacccggtcaattgctttgtcttttgctttttaaatagtccagattaagaaaatacaccctgttgggttaaatttgcctctcttgatttgttaatcagatgatatccaaaaagatccctggacactcccctgactcacaggtgctctgatctggctcaggctggcgccacatgtgctccacaggggtgcagtctggccagctacagacgcccctgtggtgccacattggacagaatggaagctgctgcaggctcaaggcagaacaggatgcttgatcctgaagggttagcagcactttacgcaagtcagtgttagtagggtaagtgggaacagtgtttccaacttctaaattcttgtttggatttaattatatcattttataattcttgccttggcagcaaattttggagagtagtgggagtggccattataaaatgatggaaaggatttaattttgccagcttaaagtaatttttacttttctaaccctgatgtgttttcagtttcaaaattaagacaaaaaaccagctgagacaatggaattagggcaggtttgtttcatttctgcttgtgaaggcttttagtagcaggcatcctgcagctcagtggtgcctctaacacagattgttgcctgccttccgtcgttttgatccttgagagtgaccatgagggccatgttgcagttccctgggaatacaagcataacagctttcagatcccagttcttggtgttggtgaaaaggtctccaccagcccctcctctcattcccaggtcattcagtggcagccagtaggctgcttagactcaggctggataaggaagtgttgggctgtggtgaaacaaccttgcagaaaacgtgattttgcttggaaaggtgctgattctaacctggtcctgctctttaagtccccttgctggtgatggctgattccagggactgttttgggctttgaacacctcttggttggtttctgagatcctcttggccttactttgaagtggccttttctttaaggatcatgtccacgtaacctgtattcttgctgctttaactcatttcaagcctctgactgcaggtccatttcatctcctgtcaggttggttaagtaaagtcagcccaaagtcaagaattacttaaagagatgcaaaccaaatatttgggctccaactttcacagggcttatagcccttattagcagtttgtgaaactttgggtttcatgaagtgagacctgtcctctggctactgaactccatggagccacgttcatgctccctcttctactggcctggctgctcctccctcaatgaggagaggcagctggctcagagaggtgggacagacacatgctgtcatcagttaagtgagctcttttccagaagtatctcagataatgttgggttaagacagatagatgttgaaaatggtggagatcattacacattagcataaaacaggacaggaagagattttttgaaagaccaaattagttgagcaagtaatacttttcaagttactcctggaaggtgtttttaaggaagtgtgttacctaccatactctcctaatttgacatttctgtgtcctgaggagttacatttattgtctaacccttgccataaggctgtggtttgaggttcttttgctgttctgggctttatatttaatttcaggtgtagtcacttctaagatgtgtaattgccctcaagagggactgatttttagcttgtcattgtcagtattgaatgtggactcttctgaggcagttaggacaccagccatggtgttaacagtggatgcgttaggctccttaatctcaaggcaatatccacgctacacacatacttattagctgtcttacttgtttgggggatagttacggcaaggagcaaaaaattctaaggactctagctgtttctagtgcttttactttcatagtcctttgaggacatttcctgcagagcactcttgctcacagcccgccctctgcagggcttccagcccctggccgcaatcagcagttcatgccacatgtgtacatccatgttctgggacctgatctcattggagtccagaagcttgttgcccactttccagtgtaaatgactttatgtgcaatggggtcataggtaacattttaactcttttcttagtccaggtcataggaagtctcatcatctgacagccacttttctcccagggaaggcggtgcccactgggccctgggaatgcctgagccagcagagcagatgccccacgtgcttcctttatccagcttccattctctcagttatgaggctctttgaaaatgtcttaactttgatgtaaatttttaaagccaacccctcatcaagacagggttggtttgggtcttttgtacacagggtctggaccttctcattgtgtgcctcccaccagcgtgcacttcgtatgtccagccctgggtcccttcagcagcattgtgcgtgtacaggtttctaggctgtaagactgaatgaatgtacatgtgtttatatcctctccatatgtacagtgtatatagtgtgtgtatgtgtacatagatgtatattatgtatacagacatgtatccaaactttcctttaaagagagtttttcataaagttgctaatgtaaactgatatgggtgttccaaggtccctcggcagggaagatttgctggtgattttcttcactccattttcctttgggtgagcctgcctgggaagggccatgaagtcagaatctccactctgcaaaaggaagaattccaggcagaagaggttctgacagggtgacatttccgtatattctctaggttcggacaagagccaggaagctggaagacagtttatcttaatatccaaaactaagtgggaatttttaaccttttcatgcacctattcatggccctacctggaaggaacttggcagttgggttgagccatcagccttcccagctattcagctctgttgagtagcccagagacaggcgtcacggtcagagattcagaacggtctgtgtcagtgaggcctgactcccaaagatggtagcaatttcccaggcttgcgctgtgctcagtcagcaagatgtggggcactgtcctatgactgaataaatagtaattcccatctttctatcgccagttaaaaataaacaacctaccaagtattattctttaaaactaagcatggatgttgatggctaacttctgcggcatataagctacagatctcaagttacttctctaactgtaagcatgtaaatgactttaactcctttctataagttatgattttaaattttcagataagaattgcattttaatatggatatgtgtgcccttaaaagctacagataccaaattttcctcgtccaggtctactcggacgaattttcccccttaatctggccttaaactgagactcggcccttgagagccagggcctggcccagcagtagttgctcatagacctgggaagcaggggcctgctggaaggaatcactagattgctgcaaaaactcacataatccacagtttcctctttttctttttaaaataagttatcaaaatgttttaaaaacactttatgagaccatagtactcagtgccttttgtgagacagtgggtcatttagccttcagcttccctgtttttgatgtagagaaagcttctatttcactggcctcatcccacaagattgtgcgacctttccccgtcatagcctgtcgtgacaatcacgctattgaaagtggctttctagttaaaatgcaattggaaacttgacagtctctaaatgaattaaaagtttcctttggggctatttagcttaacagcagtctacaaataattaaagtgtgagcttaagaaaagtatctttgcggggagaaaaatgtcagatatttttaatgcccagctataaataattttggtgtcttgatatttatacatgcaaaatagaaaaaaaatgttcaacatttattgattgatagactgttaaaatttaatgtttggaataacatttggaagtagtagactttgcattaaaaaatggcttttctttaggaaagtataatcaattattttaatgaccatagcattcatggactcaaatgctgctgccacacacaactcaagtgctggaatatttttctacagtctctctgttctacggattatcttgtaaaccagtgttcaactagttttataactgaaaagctgcacatttttcacagtacaagccgtagtttttacctgtagtttggacttctctgttagaatgtaactgcattaccagcccttttaaaggcatctatctatcaaaggaaaatttgggtgttagattttcttgggaccgtttctgtaacctttgcccttcacaatatagaaaatattggttttgccattacattttaatgccaggtttaaaacctgttgaaagctgcagctttatacagctttcttctccctgtgaaatcactttgtttatgtgatggcatttaaaaaatagcatgttctttttaaactgaattttatatctaatcaatgtcttcagtcttgaagaagaatttgcattgttgtgtttgtatatagagtattgcagtgcatgaattagctttatgcattttattaaatgctgtttcaatgtggcattattgttgtggcttaatactactacctaaatgaggtttatactattaaaagtgaattaaagactaa

SEQ ID NO: 160922 - DNA, 2612 bp, Homo sapiens
  Payload ID: 11437
  Gene Symbol: NR2E1
  Gene Name: nuclear receptor subfamily 2, group E, member 1
  Uniprot ID: Q9Y466
  ENST ID: ENST00000368983
  CDS Start-End: 5-1273
agaaatgtttcgagctggggcagagggagcagagaaggagccctcaccgcggccggaatgcagagcggaccctggcccaggactgggtttccctttaggctcgggcctaccctggccctcgctgttggaatctccaggaggccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccagggaggctgtccggtggacaagacgcacagaaaccagtgcagggcgtgtcggctgaagaagtgtttggaagtcaacatgaacaaagacgccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaagtacccccatgaagtgaatgggaccccaatgtatctctatgaagtggccacggagtcggtgtgtgaatcagctgccagacttctcttcatgagcatcaagtgggctaagagtgtgccagccttctccacgctgtctttgcaagaccagctgatgcttttggaagatgcttggagagaactgtttgttctaggaatagcacaatgggccattccggttgatgctaacactctactggctgtatctggcatgaacggtgacaacacagattcccagaagctgaacaagatcatatctgaaatacaggctttacaagaggtggtggctcgatttagacaactccggttagatgctactgaatttgcctgtctaaaatgcatcgtcactttcaaagccgttcctacacatagtggttctgaactgagaagtttccggaatgctgccgccattgcagcccttcaagatgaggctcagctaacgctcaacagctacatccataccagatatcccactcaaccctgtcgctttggaaaactcctgttgcttttgccagctttacgttctattagcccatcaactatagaagaagtgtttttcaaaaaaaccatcggcaatgtgccaattacaagactgctttcagatatgtacaaatccagtgatatctaagctcacaagatacccacttttcaggatgggacagtatcagatgaacttcaacccatggagaacaagcctcaactaacaaacccttcaggaagcatataccggggaatgtgtagccttcaggaaaaaaatgccaattgacacaaagcattccagtagctatgacctgccgccctgaccaggatagggcgggtgggaaggagaggggtgcaacaggaccgcctgcactgaaaactcactgctgccatgccctgggagggggcaaactgggggttgccacaggccgtgccattctgcctcttacctggaagatcaggctgaacgatcaaaagctgaaacataagtagtgctttctcttcctttttagcatacaaagtttggtaaccaaatatagctctgtgtataacatcgtactgcggccttcaaaactacgttatgttggagcatttattttaaaaataatggtaggttttaaattaaaagtgttatcaaaagtttcccctctattgtaatacattattaagtggccttcagaactgagttaataagtgaaaagtagcttatgccatgtgatttgctttttctctatcttcttttttcttttctttctctttcttttgttctttcttcttcttttttaataccataggccaggcaaccttgtcaaaggaattgatggacaaaatgagattctcaccaggacttcaggttggataacatgtcaaaaagagaagagctttactaaaagaacataagtcaagggaggatgaataaaaacagcaaaaccaaataaagtggagatgagtgattgagtgaggtagattgctgtcccgttaacatagtgctgaaaccaaaggcagtgggggtccaaactcgtggtgcagcaagtcacaccagacaggaaacgaatatggacgtaattgcagaaggaacttcaaggagatgaatgaatgctaaaagggttcttgactgatccattgctaacagcctgagactcttcaatgcctttccgaaaactggtttctagtaaagccttgaatgaacacacacacacacacacacacacacacacacacacacacacacacacaccgtcctacactttaagctgctcctttggtatgactctatacttatggaaatgtagaaacaaacatttttaaatagctgctgtacttttcacattttgatttattaggtactagcactgaggaaaaaaaattcagcacttggactatcataggatgagtaaaacttttcttgtacaaagtgaattaactgatttgtgaagttaaaaggttgtactcattgtatttacaaagaataaaaatatattgaattt

SEQ ID NO: 160923 - DNA, 3212 bp, Homo sapiens
  Payload ID: 11437
  Gene Symbol: NR2E1
  Gene Name: nuclear receptor subfamily 2, group E, member 1
  Uniprot ID: Q9Y466
  ENST ID: ENST00000368986
  CDS Start-End: 709-1866
ggagatattacaggggacccagcccgcagcgacaggcacaaagtcacggggtaatgaacttcggggacccttcgccgctgcgtgcgcggctctccccggaaacccggacctggccgcctcttccctcggaagatttcccagcaatctagttttcccactctgcgcttgggttccggcagcgcggagcccgtctgcctctgagactgcggtagtgttttccttctttccttgggagaccagcggtcggcagagattgcccacactctgcatgcctatgtagagggagagatcgaagactgagtgacaggaatggggaaaaagagggatttcgctccgtaggaaggccattttcgtgtctccatctctgtctttcaacatccctctcttgctgttcttccttcttcctcagtcttcctgtccatctctccatctgtctgtccatgtgtgtgtccatatcaagcagcattcccagcagctgcggttttgcaagagccgggaagaaacttaaggatgcttaaatttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccagggaggctgtccggtggacaagacgcacagaaaccagtgcagggcgtgtcggctgaagaagtgtttggaagtcaacatgaacaaagacgccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaagtacccccatgaagtgaatgggaccccaatgtatctctatgaagtggccacggagtcggtgtgtgaatcagctgccagacttctcttcatgagcatcaagtgggctaagagtgtgccagccttctccacgctgtctttgcaagaccagctgatgcttttggaagatgcttggagagaactgtttgttctaggaatagcacaatgggccattccggttgatgctaacactctactggctgtatctggcatgaacggtgacaacacagattcccagaagctgaacaagatcatatctgaaatacaggctttacaagaggtggtggctcgatttagacaactccggttagatgctactgaatttgcctgtctaaaatgcatcgtcactttcaaagccgttcctacacatagtggttctgaactgagaagtttccggaatgctgccgccattgcagcccttcaagatgaggctcagctaacgctcaacagctacatccataccagatatcccactcaaccctgtcgctttggaaaactcctgttgcttttgccagctttacgttctattagcccatcaactatagaagaagtgtttttcaaaaaaaccatcggcaatgtgccaattacaagactgctttcagatatgtacaaatccagtgatatctaagctcacaagatacccacttttcaggatgggacagtatcagatgaacttcaacccatggagaacaagcctcaactaacaaacccttcaggaagcatataccggggaatgtgtagccttcaggaaaaaaatgccaattgacacaaagcattccagtagctatgacctgccgccctgaccaggatagggcgggtgggaaggagaggggtgcaacaggaccgcctgcactgaaaactcactgctgccatgccctgggagggggcaaactgggggttgccacaggccgtgccattctgcctcttacctggaagatcaggctgaacgatcaaaagctgaaacataagtagtgctttctcttcctttttagcatacaaagtttggtaaccaaatatagctctgtgtataacatcgtactgcggccttcaaaactacgttatgttggagcatttattttaaaaataatggtaggttttaaattaaaagtgttatcaaaagtttcccctctattgtaatacattattaagtggccttcagaactgagttaataagtgaaaagtagcttatgccatgtgatttgctttttctctatcttcttttttcttttctttctctttcttttgttctttcttcttcttttttaataccataggccaggcaaccttgtcaaaggaattgatggacaaaatgagattctcaccaggacttcaggttggataacatgtcaaaaagagaagagctttactaaaagaacataagtcaagggaggatgaataaaaacagcaaaaccaaataaagtggagatgagtgattgagtgaggtagattgctgtcccgttaacatagtgctgaaaccaaaggcagtgggggtccaaactcgtggtgcagcaagtcacaccagacaggaaacgaatatggacgtaattgcagaaggaacttcaaggagatgaatgaatgctaaaagggttcttgactgatccattgctaacagcctgagactcttcaatgcctttccgaaaactggtttctagtaaagccttgaatgaacacacacacacacacacacacacacacacacacacacacacacacacaccgtcctacactttaagctgctcctttggtatgactctatacttatggaaatgtagaaacaaacatttttaaatagctgctgtacttttcacattttgatttattaggtactagcactgaggaaaaaaaattcagcacttggactatcataggatgagtaaaacttttcttgtacaaagtgaattaactgatttgtgaagttaaaaggttgtactcattgtatttacaaagaataaaaatatattgaatttaaatgaa

SEQ ID NO: 160924 - DNA, 517 bp, Homo sapiens
  Payload ID: 11437
  Gene Symbol: NR2E1
  Gene Name: nuclear receptor subfamily 2, group E, member 1
  ENST ID: ENST00000426403
  CDS Start-End: 381-517
aggactgggtcgagcagacagagctgcagcccccgccttgcccggcttctcgcggctggagagcagagcgatgtcacccggagccccgcctgggtggtaacgagaccctggccagtcacccctgcagcccagactaacttctttcaacagcctctgatggccgcattttagatatcccctgcaaagtgtgtggcgaccgcagctcggggaagcactacggggtctacgcctgcgacggctgctcaggttttttcaaacggagcatccgaaggaataggacctatgtctgcaaatctggaaaccagggaggctgtccggtggacaagacgcacagaaaccagtgcagggcgtgtcggctgaagaagtgtttggaagtcaacatgaacaaagacgccgtgcagcacgagcgggggcctcggacgtccaccatccgcaagcaagtggccctctacttccgtggacacaaggaggagaacggggccgccgcgcactttccctcggcggcgctccctgcgcc

SEQ ID NO: 160925 - DNA, 2032 bp, Homo sapiens
  Payload ID: 11438
  Gene Symbol: NR2E3
  Gene Name: nuclear receptor subfamily 2, group E, member 3
  ENST ID: ENST00000621736
  CDS Start-End: 489-1457
cagcagcagagttaagtagtattgctttaattgcaacaagctgagctaatgtgggaagaatgcagtagagtggcacagaagaatgctaacccgaaactctaagcctgttccctggaatcttccatctggatggaggagagaaagttgacctggagtgaggttcaatgtaaggacaagatctgcacccggagaagctctctctcggagagcacaggcggcctgaggagtcaaaacaggtggcctgtggagtcagcacaggcagcctggaggaggtgaggaactgaagtttggacagattgagtcactttctcagggacacatggctggccggtgatggagaaggcgtgagcccctcgctccagtgccgcgtgtgcggagacagcagcagcgggaagcactatggcatctatgcctgcaacggctgcagcggcttcttcaagaggagcgtacggcggaggctcatctacaggtgccaggtgggggcagggatgtgccccgtggacaaggcccaccgcaaccagtgccaggcctgccggctgaagaagtgcctgcaggcggggatgaaccaggacgccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatgctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccagagacgcggggcctgaaggatcctgagcacgtagaggccttgcaggaccagtcccaagtgatgctgagccagcacagcaaggcccaccaccccagccagcccgtgaggtttgggaaattgctcctgctcctcccgtctttgaggtttatcactgcggaacgcatcgagctcctctttttccgcaagaccatagggaatactccaatggagaagctcctttgtgatatgttcaaaaactagtgggggtggaggtgaaatgtttccaagcactctggaaaacaatctactgaaacgaaacatttgcctactctttgccccagcaattcctcgtaggtgtgtgtacccagcagaaatgcccaccgaaagatattgtaagaatattcatagcagctttattcataatagccccaaactgtatattgatggtaggatgaattaacaagttgtggtatattcatataatgaaaaataatttaaaaagaatgaattacggatacatgtggcaacacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctcaataaaaaagtaaaaaaaaaaaacaaaaaaaaccagaaaaa

SEQ ID NO: 160926 - DNA, 2064 bp, Homo sapiens
  Payload ID: 11438
  Gene Symbol: NR2E3
  Gene Name: nuclear receptor subfamily 2, group E, member 3
  Uniprot ID: Q9Y5X4
  ENST ID: ENST00000621098
  CDS Start-End: 153-1256
ttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggcgtgagcccctcgctccagtgccgcgtgtgcggagacagcagcagcgggaagcactatggcatctatgcctgcaacggctgcagcggcttcttcaagaggagcgtacggcggaggctcatctacaggtgccaggtgggggcagggatgtgccccgtggacaaggcccaccgcaaccagtgccaggcctgccggctgaagaagtgcctgcaggcggggatgaaccaggacgccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatgctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccagagacgcggggcctgaaggatcctgagcacgtagaggccttgcaggaccagtcccaagtgatgctgagccagcacagcaaggcccaccaccccagccagcccgtgaggtgacctgagcatgcgcccacccactcatctgtccctgacctctaacctttctctgcctctcccacactctcccagagctcactgattagacagcacaagggtctcagttcaacagcatacagccaacatctatggtgtcccaggcacagtgccaggccccgggagtggggaccaagatgtacataagacaaagctactgccttctagagacaaccggcagtgacctcactgaagacaaaaactgccctagccaggtactgagggttgcatgaatctgcaggagacagagatccccttgcatgggaaacataaagcagaattgggagggactttgtggagacagggctggacttgaaaggaagaagaagtctaaaagaaaacatcatttgcaaagggagagaggggcaagcatgatatgttgttagaacaggagcccactttgaaggtataacaggttcctgccagtgagaaatggggagaataagccagaaaagtaccctaggaccagcccgttcaggactttgaatgccagccaaaggccacgtctgacttgggaggcagagggcagctactgcaggtttccgagcagagggtcatacacagggctggacctcacgcagactggcatggccatgggtccagaggatactactgggaaggggatggcagctactgccaccttccagatggttccatggagttctgatctttgggcatggccaggggaagcagaagggagactctaggagttgaaatgggtcagacccggtgtttgggtgaaggtaaggaatgagggaagaggagctctttg

SEQ ID NO: 160927 - DNA, 1998 bp, Homo sapiens
  Payload ID: 11438
  Gene Symbol: NR2E3
  Gene Name: nuclear receptor subfamily 2, group E, member 3
  Uniprot ID: Q9Y5X4
  ENST ID: ENST00000617575
  CDS Start-End: 191-1423
agaaatctcctcaagccagagcctgtgctgtgaggggcttcgggaccttggggcagctcctgagttcagacagagttcaggaagggagacaggggcacagagagacagaggttcatggactgaggcaaaggctgggccaggctcagcaacccaggcctcccgcaggcaggcagaggctgccctgtaacccatggagaccagaccaacagctctgatgagctccacagtggctgcagctgcgcctgcagctggggctgcctccaggaaggagtctccaggcagatggggcctgggggaggatcccacaggcgtgagcccctcgctccagtgccgcgtgtgcggagacagcagcagcgggaagcactatggcatctatgcctgcaacggctgcagcggcttcttcaagaggagcgtacggcggaggctcatctacaggtgccaggtgggggcagggatgtgccccgtggacaaggcccaccgcaaccagtgccaggcctgccggctgaagaagtgcctgcaggcggggatgaaccaggacgccgtgcagaacgagcgccagccgcgaagcacagcccaggtccacctggacagcatggagtccaacactgagtcccggccggagtccctggtggctcccccggccccggcagggcgcagcccacggggccccacacccatgtctgcagccagagccctgggccaccacttcatggccagccttataacagctgaaacctgtgctaagctggagccagaggatgctgatgagaatattgatgtcaccagcaatgaccctgagttcccctcctctccatactcctcttcctccccctgcggcctggacagcatccatgagacctcggctcgcctactcttcatggccgtcaagtgggccaagaacctgcctgtgttctccagcctgcccttccgggatcaggtgatcctgctggaagaggcgtggagtgaactctttctcctcggggccatccagtggtctctgcctctggacagctgtcctctgctggcaccgcccgaggcctctgctgccggtggtgcccagggccggctcacgctggccagcatggagacgcgtgtcctgcaggaaactatctctcggttccgggcattggcggtggaccccacggagtttgcctgcatgaaggccttggtcctcttcaagccagagacgcggggcctgaaggatcctgagcacgtagaggccttgcaggaccagtcccaagtgatgctgagccagcacagcaaggcccaccaccccagccagcccgtgaggtttgggaaattgctcctgctcctcccgtctttgaggtttatcactgcggaacgcatcgagctcctctttttccgcaagaccatagggaatactccaatggagaagctcctttgtgatatgttcaaaaactagtgggggtggaggtgaaatgtttccaagcactctggaaaacaatctactgaaacgaaacatttgcctactctttgccccagcaattcctcgtaggtgtgtgtacccagcagaaatgcccaccgaaagatattgtaagaatattcatagcagctttattcataatagccccaaactgtatattgatggtaggatgaattaacaagttgtggtatattcatataatgaaaaataatttaaaaagaatgaattacggatacatgtggcaacacaggtaaacttcacagacataaaagttgaatgaaagaagccaggccgaagttccatttatgcagagttcaggaacaggcaagactaattgacaataatagaagttggaatagtggttacttctgggtggtgggggattgatacagagggggctcatgggagccctctggtgtaccagaaatgttgattttgatctgggcagtggtttcacaaatgtattcatacgtaataattcattgagctgtgcactttattttgttagacctcaataaaaaagtaaaaaaaaaaaacaaaaaaaaccagaaaaa

SEQ ID NO: 160928 - DNA, 3732 bp, Homo sapiens
  Payload ID: 11439
  Gene Symbol: NR2F1
  Gene Name: nuclear receptor subfamily 2, group F, member 1
  Uniprot ID: P10589
  ENST ID: ENST00000327111
  CDS Start-End: 1688-2959
cctctttctcccccctctctccctcctctcctctctctctcctctcttctctgaacctctcttctctttctcttttcttacatattctactagttgttttccccttcttcttctcctttctctcctttttctccctcctccttgtctcttttactccattcctgcagaagagagagggctaaacttaaagaaaaaaaaaaggaggaggaggaggaggaggcacccccttcgtattcttcttatcgttattttatacatatatgattttttttggagggagggtgttggttgccggctgaagagcacttatttaaaatactaaaaaaagaacatttttgggcgatctccagggtttttttaactagctctgtgtgttatagcagaagaagcagaagaaggagcaagaaagaggaaaagaagaggattatttattcgacctactttggatgtctctctcgcttttcctttttcctttttttggcaattattttcttctgatttttattttttctatttcgctgtgatttcgtcgccggcgtgaattatcccgtatttttctcccccttccgtcacctcccgaaagaagaaggcagcgagagcccggcgccaccggcacaacaaaaagagcaaagtgtgtgatcttcctcgccggctgcctcccgctctccagcgctgccttcctgaatggctggctgcgtccggccctggacctggccccccgacacccgcgcgccctgatcgccggcggcagcctcgcccagcgccctgctcggctcaccgcgctccccgcactcccgagcccggcgagggctcccgccgggacagcggcggcgccgcgggcggccccggcctccgctcgcgctccggctgcggccccgactcctgctcggactccggcccgggtcccggctcctccagcggcgctcgccgcagcagctccggcggcagctccagcggcgcctgcagccgcgacctcctcctcctccgccgccgccgccgcctccgccctcgccggcttcctctatgtcggctcagcccgcgcgctgcgcgtagcccgagcggccggcgggcgggcgcccggcgcgggtgagcgactgtgtgtgcgagtgtgtgtgtgcgcgggggtgcgggcgaggcggagggcgagtgtgtgcgcgcgccgtggcccatgcccgccgcccccggcgctgcgccccgcgccgctcccggctgccgcctgtgccatttctgattttgcaacttggggaagaagaaaaaagcgagagaagggagcttgctcgccggggggtggggaggggggaaggagagcgcggcccccccaggaacggagcgcggggggagcgggcgaggggagcaggggtgttggggggggagcctgagagcctgggggggctgcaaaaagagagaaagaaaacagcaggaaccacaacaaaacgccagcagggcgggcgggcgcgcagcagcagcggggcggccgaggcagtagcggcggcagcggcggcggcggcggaggcagcggccggtgtccggctcgggctcggctcctgcgaccccggggcgcccggcgggccccccgccccctccccctccccccttccccttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaaccca

SEQ ID NO: 160929 - DNA, 1427 bp, Homo sapiens
  Payload ID: 11439
  Gene Symbol: NR2F1
  Gene Name: nuclear receptor subfamily 2, group F, member 1
  ENST ID: ENST00000615873
  CDS Start-End: 1-1197
atggcaatggtagttagcagctggcgagatccgcaggacgacgtggccgggggcaaccccggcggccccaaccccgcagcgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgagg

SEQ ID NO: 160930 - DNA, 5275 bp, Homo sapiens
  Payload ID: 11440
  Gene Symbol: NR2F2
  Gene Name: nuclear receptor subfamily 2, group F, member 2
  Uniprot ID: P24468
  ENST ID: ENST00000394166
  CDS Start-End: 1390-2634
agccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggcggcggctccggcggcagcggcggcccgggcggcccgcagggaacggcgagcggcctccacccagcgactgcgggcggcggcggccggagagagcgaggcgcgcgccggacgcccggggcaggcggcggcggcggcggcccagcgccaggacgacgccgcgcagcgcccgacgcggaccactttcatgctgattcccccggacccgggcagcgctccggccactccgcgggccgccggcctccgccccggcctgcctggctccctgggcgcgcccgcacccggcgcctccgatctcctagtcctcctgatttcgatggctttcctgaatggctgactgtgggctgccctggacttggcccccggacagtcgcctctcctcctcctctacctcctccttcaccaccacctcctcttcctcctcctcctcctcctcctcctccgccaactcctcggctgcacaccagctctaagagcgagagtgaacgagagagggagggagagagtgagagcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagcccccgagccacccggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggggcatttgtttactcccctcagtcagtttgttcaaaggtggactactgtatttgcctgtttaatttgggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggtctacttttaatgtatatatgataacttgcagttggtttccctctcccctccccccctttaccttcagtctgtgagagcatgaccacagggtcaagggaatcttttccattggagttatgtacataaaaacacatcgacattttgacatttcagattgtgtggctacaatctgtactgctcttgggatcctttgtccttagaagccaaattaaggaagagaaagcaggacagagaaaaagaaagaaggaaggagggaaactttacagggtgtgctgatttggaagtagtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatccatgtgagtgtgtgaagtttctctaataagtaaaacacaggcccttttccttgtttgttttgtgttagtttattgtaaacagccatttgttgtaaattattattggcattaaattataatttatgattttcaaagcaaaagacaa

SEQ ID NO: 160931 - DNA, 3501 bp, Homo sapiens
  Payload ID: 11440
  Gene Symbol: NR2F2
  Gene Name: nuclear receptor subfamily 2, group F, member 2
  Uniprot ID: P24468
  ENST ID: ENST00000394171
  CDS Start-End: 75-860
ctccttccctcgtcctgggtcccggggtcctgggtacgtttggctagcctgctctggcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggttttttttttaagtgcaacatttctgtatactgtaaaagttataataactgaactgtttggtcgagtctttgtgtgttatattccaaggaaaattgaaagtattcagaaattaaaatattatttgatatctgaaacctggctgtccccactcactgtctttacatctagaagagcccctgtgagctctcgcttagctggccgggcggggggtggtgggggggggcatttgtttactcccctcagtcagtttgttcaaaggtggactactgtatttgcctgtttaatttgggtgtgtgtgtgttggggggggagctgaagttaatggtttatctatggtttaggaagtgccatactgatatagtaaaccacccccattcacctaatcctccttttaattaaaaatggattttccaggaaaaaaaaaaaggcccttatatttgtcacacttaagtgcctgcttagggaaggtattgtgaaaaagtattagaaatcttgagatcagtatctattttatgatcagaaaaaaatactcttttgtacatttctgacagttactcagaagatcgttcaagcaagctaatcacagcattgtaactagaggacagttgtttgcagtgagtttttccttaagtaggtacgattttttaaaatattctgtgattctactctagcgtggttgttgagagagtttcaaattcagtgatacaggttctaagactgaaaggtctacttttaatgtatatatgataacttgcagttggtttccctctcccctccccccctttaccttcagtctgtgagagcatgaccacagggtcaagggaatcttttccattggagttatgtacataaaaacacatcgacattttgacatttcagattgtgtggctacaatctgtactgctcttgggatcctttgtccttagaagccaaattaaggaagagaaagcaggacagagaaaaagaaagaaggaaggagggaaactttacagggtgtgctgatttggaagtagtaactatttcttttggagtctttttttcatttttcctctttctcttttcctggtttggaggaagctcggtgctgggagcttgcaattttgttcttattcaaggtttccaacccacccccccaccgccagtacttcatcatgttgtggtttaattctaattggtgggggggggggaggactagtgagggaggtgaaagaacagggataattttgtaaagtgtattaaacgttaatattcagatccagtcaatacatgcagaccagtaaaatctgatttgtgcagagttctccatctgactctcacttatttctgtagatatatacatatataaatacaagtatgttcttacggcacagtattgctgacctttagttcgaggttttgtcggttgttgttgattttcttcctcttgcaagtgctatccatgtgagtgtgtgaagtttctctaataagtaaaacacaggcccttttccttgtttgttttgtgttagtttattgtaaacagccatttgttgtaaattattattggcattaaattataatttatgattttcaaagcaaaagacaa

SEQ ID NO: 160932 - DNA, 1712 bp, Homo sapiens
  Payload ID: 11440
  Gene Symbol: NR2F2
  Gene Name: nuclear receptor subfamily 2, group F, member 2
  Uniprot ID: P24468
  ENST ID: ENST00000453270
  CDS Start-End: 713-1498
gcgaggggccctgggcggctgctttcgctctgcgcgagttgggtctttgtgatataaaattcgccgagcgccgcgagccgtgctttgccaatggcgcgctcggcgcggggcgcgggctccgggttggggcgagccaacgccggggtttctttgtgtttctgcgagagcgactctcccggtccggagtcagataacagcctgggcccgagcctcgccggctttccccggcccttacaggccctgcccaggctccgctagtgccggccgcctgctccctgcctctcccggcttcctctctctttagccggcctctctctctccgccctctccctccgtctctttctccgagcacactgattagacagacgccagacctccgctctctgcttgtctctcactgggggggttccccgccgggctggggctggggcttcggggtttgtgggagagtcgttccggagtggccacaggccgtctggggtggaccctcgtgccttttgcaaaagcgcctcaccctccccccagactcgcccctcccgctccctctcctccaatcaataagaaatatcagctgtttagcagtaaagaagaaagatgccctcagaatgctacatcccgcccacagcgccggggaccccgaggcaaggtggccaattctgggtcctcggcggaccagccccgagcgggcctcggagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaa

SEQ ID NO: 160933 - DNA, 2214 bp, Homo sapiens
  Payload ID: 11440
  Gene Symbol: NR2F2
  Gene Name: nuclear receptor subfamily 2, group F, member 2
  Uniprot ID: P24468
  ENST ID: ENST00000421109
  CDS Start-End: 373-1218
aggatcactccagacatctcctacctacggtttggggttttttttcttaaaggcgaggcttgcattcctcagcagctatgtacaaagctccctgaaaccttgtctctctaaagttagtgtgcagggttttccaaggctgagagagcctaatacatggggaagcacttccttgaggtggaagatctctcccttcacctttcctctttttccctgcaggctagtgcctactttttatcagtttgcacaatcgcttagataaacaccgaggaggagattctctttaattatcaaagacacatcttttcagggggccaacaaagcatttatttcacccgccaaactaaaggagagttattccagtttaggaggaagatgcaagcggtttgggaccttgaacaaggcaaatatggttttgcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaaagactgtcaaatgaacttttacagaatgcattaaaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcactta

SEQ ID NO: 160934 - DNA, 382 bp, Homo sapiens
  Payload ID: 11440
  Gene Symbol: NR2F2
  Gene Name: nuclear receptor subfamily 2, group F, member 2
  ENST ID: ENST00000559679
  CDS Start-End: 103-382
gagacgggaaggtatcggcctctcatttctccttccctcgtcctgggtcccggggtcctgggtacgtttggctagcctgctctggcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcc

SEQ ID NO: 160935 - DNA, 2404 bp, Homo sapiens
  Payload ID: 11441
  Gene Symbol: NR2F6
  Gene Name: nuclear receptor subfamily 2, group F, member 6
  Uniprot ID: P10588
  ENST ID: ENST00000291442
  CDS Start-End: 721-1935
gcgaatggaacgctgtgtgtcaaaccggccgcagcgcgaggccggcgcgcggggtcggtggcggtggcggcggcgagagcgaggcttgggcccaggcgcaggcccaggccaggcaggagcggccgcagcgggggcggcagctccagaggcgccggcccagcggccctgcaggcccggagcggcagccgcgggcgccgggggacccagggggcgcggcgatcagccccggcgcgcacccgccgcccctccccccccgccacgggcggccgcgcaacttgcggccaaactttccccccggcctcccgcgctcggatggcggcccgctgagttggccgcagcccccgggcgagcggcggccaggccagaggacgccccctgcgcggctcgggccgggccatggcccgcgcgcccccgccggggccccagggcggcgggacgcgagtcctctgggcccccggcccgcgcctctagcgtgcccctcccggccccgggcccggccccgcgcacgcgtgggaaagttggcctggaaccggcccgaccagttccgcccgggcgcgaggaccggccgcaggaagttgctgcaaaacttttttggggggtgcagcccgtgccccccgcgcgccggggccgaatgcgcgccgcgtagggtcccccgggccgagaggggtgcccggagggaagagcgcggtgggggcgccccggccccgctgccctggggctatggccatggtgaccggcggctggggcggccccggcggcgacacgaacggcgtggacaaggcgggcggctacccgcgcgcggccgaggacgactcggcctcgccccccggtgccgccagcgacgccgagccgggcgacgaggagcggccggggctgcaggtggactgcgtggtgtgcggggacaagtcgagcggcaagcattacggtgtcttcacctgcgagggctgcaagagctttttcaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctgcaca

SEQ ID NO: 160936 - DNA, 731 bp, Homo sapiens
  Payload ID: 11441
  Gene Symbol: NR2F6
  Gene Name: nuclear receptor subfamily 2, group F, member 6
  ENST ID: ENST00000596878
  CDS Start-End: 355-731
cggccgcgcggatcgatacggcgcgcccttggggtcaaatatcacttccaaagtcgctgtggctacggaggcggcagacggagggaggctggggtggcacggggcggccttcttcgcatgaggggcccagcggtgggggtgggggtgggagctgggcttgcccatctcagggaacccctctgggctcactctgggccttgggtcaccggaaatcgccactggaaggccggcagggccaccggaattgactgaaacgtccctctcccccaggggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaa

SEQ ID NO: 160937 - DNA, 3556 bp, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENST ID: ENST00000231509
  CDS Start-End: 493-2829
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattg

SEQ ID NO: 160938 - DNA, 7286 bp, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENST ID: ENST00000343796
  CDS Start-End: 995-3328
aggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagagggtaagagaagaaaaaagggaaagtggtgaaggcagggaggaaaattgcttagtgtgaatatgcacgcattcatttagttttcaaatccttgttgagcatgataaaattcccagcatcagacctcacatgttggtttccattaggatctgcctgggggaatatctgctgaatcagtggctctgagctgaactaggaaattcaccataattaggagagtcactgtatttctctccaaaaaaaaaaaagttatacccgagagacaggatcttctgatctgaaattttcttcacttctgaaattctctggtttgtgctcatcgttggtagctatttgttcatcaagagttgtgtagctggcttcttctgaaaaaaggaatctgcgtcatatctaagtcagatttcattctggtgctctcagagcagttagcccaggaaaggggccagcttctgtgacgactgctgcagaggcaggtgcagtttgtgtgccacagatattaactttgataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 160939 - DNA, 6795 bp, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENST ID: ENST00000394464
  CDS Start-End: 504-2837
gtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 160940 - DNA, 3245 bp, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENST ID: ENST00000394466
  CDS Start-End: 158-2494
actggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtc

SEQ ID NO: 160941 - DNA, 3789 bp, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENST ID: ENST00000415690
  CDS Start-End: 133-2361
tttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaaaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgcttttt

SEQ ID NO: 160942 - DNA, 4591 bp, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENST ID: ENST00000424646
  CDS Start-End: 14-2269
ttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattgcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttg

SEQ ID NO: 160943 - DNA, 498 bp, Homo sapiens
  Payload ID: 11442
  Gene Symbol: NR3C1
  Gene Name: nuclear receptor subfamily 3, group C, member 1 (glucocorticoid receptor)
  ENST ID: ENST00000502892
  CDS Start-End: 63-498
aatccagctcgctggaggttttgcatttggcgtgcaacttccttcgagtttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactg
